(12) United States Patent
Bentwich et al.

(10) Patent No.: US 8,481,506 B2
(45) Date of Patent: Jul. 9, 2013

(54) NUCLEIC ACIDS INVOLVED IN VIRAL INFECTION

(75) Inventors: Issac Bentwich, DN Misgav (IL); Amir Avniel, Tel-Aviv (IL); Ranit Aharonov, Tel-Aviv (IL); Yael Karov, Tel-Aviv (IL); Yonat Shemer-Avni, Beer Sheva (IL); Asal Levy, Nes-Ziona (IL)

(73) Assignee: Rosetta Genomics, Ltd., Rehovot (IL)

( * ) Notice: Subject to any disclaimer, the term of this patent is extended or adjusted under 35 U.S.C. 154(b) by 683 days.

(21) Appl. No.: 12/517,760

(22) PCT Filed: Dec. 5, 2007

(86) PCT No.: PCT/IB2007/004718
§ 371 (c)(1),
(2), (4) Date: Apr. 5, 2010

(87) PCT Pub. No.: WO2009/024834
PCT Pub. Date: Feb. 26, 2009

(65) Prior Publication Data
US 2010/0184205 A1   Jul. 22, 2010

Related U.S. Application Data

(60) Provisional application No. 60/868,666, filed on Dec. 5, 2006, provisional application No. 60/971,265, filed on Sep. 11, 2007.

(51) Int. Cl.
*C12N 15/11* (2006.01)
*A61K 48/00* (2006.01)
*C07H 21/02* (2006.01)
*C07H 21/04* (2006.01)

(52) U.S. Cl.
USPC .......................... 514/44 A; 536/24.5

(58) Field of Classification Search
USPC ............................. 514/44; 536/24.5
See application file for complete search history.

(56) References Cited

U.S. PATENT DOCUMENTS

| | | |
|---|---|---|
| 5,034,506 A | 7/1991 | Summerton et al. |
| 5,124,246 A | 6/1992 | Urdea et al. |
| 5,235,033 A | 8/1993 | Summerton et al. |
| 5,359,100 A | 10/1994 | Urdea et al. |
| 5,545,730 A | 8/1996 | Urdea et al. |
| 5,571,670 A | 11/1996 | Urdea et al. |
| 5,580,731 A | 12/1996 | Chang et al. |

(Continued)

FOREIGN PATENT DOCUMENTS

| | | |
|---|---|---|
| WO | WO 93/23569 A1 | 11/1993 |
| WO | WO 94/02595 A1 | 2/1994 |

(Continued)

OTHER PUBLICATIONS

Bartel et al., "MicroRNAs: At the Root of Plant Development?", Plant Physiology, Jun. 2003, vol. 132, pp. 709-717.

(Continued)

*Primary Examiner* — Terra Cotta Gibbs
(74) *Attorney, Agent, or Firm* — Polsinelli PC; Teddy C. Scott, Jr.; Ron Galant

(57) ABSTRACT

Provided herein are isolated viral and human nucleic acids associated with viral infection and various nucleic acid molecules relating thereto or derived therefrom. The nucleic acids may be useful for the prevention, treatment and diagnosis of viral infections.

10 Claims, 8 Drawing Sheets

U.S. PATENT DOCUMENTS

| | | | |
|---|---|---|---|
| 5,591,554 | A | 1/1997 | Chang et al. |
| 5,594,117 | A | 1/1997 | Urdea et al. |
| 5,594,118 | A | 1/1997 | Urdea et al. |
| 5,597,909 | A | 1/1997 | Urdea et al. |
| 5,624,802 | A | 4/1997 | Urdea et al. |
| 5,635,352 | A | 6/1997 | Urdea et al. |
| 5,681,697 | A | 10/1997 | Urdea et al. |
| 5,681,702 | A | 10/1997 | Collins et al. |
| 6,506,559 | B1 | 1/2003 | Fire et al. |
| 6,573,099 | B2 | 6/2003 | Graham |
| 7,687,616 | B1 | 3/2010 | Bentwich et al. |
| 2002/0115080 | A1 | 8/2002 | Skouv et al. |
| 2004/0033978 | A1 | 2/2004 | Anderson et al. |
| 2005/0107325 | A1 | 5/2005 | Manoharan et al. |
| 2005/0182005 | A1 | 8/2005 | Tuschl et al. |
| 2005/0261218 | A1* | 11/2005 | Esau et al. .................. 514/44 |
| 2006/0142228 | A1 | 6/2006 | Ford et al. |
| 2006/0257851 | A1 | 11/2006 | Bentwich |
| 2007/0042380 | A1 | 2/2007 | Bentwich et al. |

FOREIGN PATENT DOCUMENTS

| | | |
|---|---|---|
| WO | WO 99/04819 A1 | 2/1999 |
| WO | WO 99/05094 A1 | 2/1999 |
| WO | 2005/116250 A2 | 12/2005 |
| WO | 2006/110762 A2 | 10/2006 |

OTHER PUBLICATIONS

Bartel et al., "MicroRNAs: Genomics, Biogenesis, Mechanism and Function", Cell, Jan. 23, 2004, vol. 116, pp. 281-297.

Brennecke et al. "Principles of MicroRNA-Target Recognition", PLoS Biology, March, 205, vol. 3, Issue 3, pp. 1-15.

Cheng et al., "Antisense inhibition of human miRNAs and indications for an involvement of miRNA in cell growth and apoptosis", Nucleic Acids Research, 2005, vol. 33, No. 4, pp. 1290-1297.

Doench et al. "Specificity of microRNA target selection in translational repression", Genes & Development, 2004, pp. 1-8.

Esau et al., "MicroRNA-143 Regulates Adipocyte Differentiation", Journal of Biological Chemistry, Dec. 10, 2004, vol. 279, No. 50, pp. 52361-52365.

Hofacker et al., "Fast Folding and Comparison of RNA Secondary Structures", Chemical Monthly, 1994, vol. 125, pp. 167-188.

Krek et al., "Combinatorial microRNA target predictions", Nature Genetics, Apr. 2003, pp. 1-6.

Krutzfeldt et al., "Silencing of microRNAs in vivo with 'antagomirs'", Nature, 2005, vol. 430, pp. 1-5.

Lewis et al., "Conserved Seed Pairing, Often Flanked by Adenosines, Indicates that Thousands of Human Genes are MicroRNA Targets", Cell, Jan. 14, 2005, vol. 120, pp. 15-20.

Lim et al., "Microarray analysis shows that some microRNAs downregulate large numbers of target mRNAs", Nature, 2005, pp. 1-6.

Pruitt et al., "NCBI Reference Sequence (RefSeq): a curated non-redundant sequence database of genomes, transcripts and proteins", Nucleic Acids Research, 2005, vol. 33, pp. D501-504.

Shi et al., "Facile means for quanitfying microRNA expression by real-time PCR", BioTechniques, Oct. 2005, vol. 39, No. 4, pp. 519-524.

Soutschek et al., "Therapeutic silencing of an endogenous gene by systemic administration of modified siRNAs", Nature, Nov. 11, 2004, vol. 432, pp. 173-178.

Tatusova et al., "Complete genomes in WWW Entrez: data representation and analysis", Bioinformatics, 1999vol. 15, Nos. 7-8, pp. 536-543.

Yetka et al., "MicroRNA-Directed Cleavage of HOXBB mRNA", Science, Apr. 23, 2004, vol. 304, pp. 594-596.

International Search Report, PCT/US08/52086.

GenBank-FB989997. Sequence 2015 from Patent W02005116250. Accession No. FB989997. Posting date: Jan. 23, 2009, [online]. [Retrieved on Oct. 14, 2011. Retrieved from the Internet: <URL: http://www.ncbi.nlm.nih.gov/nuccore/FB989997> Journal Patent: WO 2005116250-A2 . . . Dec. 8, 2005. nucleotide sequence that is 100% identical to the claimed Seq ID No. 15.376.

GenBank_FB989191. Sequence 1209 from Patent W02005116250, Jun. 29, 2009 [online]. [Retrieved on Jul. 21, 2011]. Retrieved from the Internet: <URL:http://www.ncbi.nlm.nih.gov/nuccore/FB989191> Journal Patent: WO 2005116250- A2 . . . Dec. 8, 2005. Sequence, 100% identical to the claimed for Seq ID No. 1.

* cited by examiner

NUCLEIC ACIDS INVOLVED IN VIRAL INFECTION

CROSS REFERENCE TO RELATED APPLICATIONS

This is the national stage of International Application No. PCT/IB07/04718, filed on Dec. 5, 2007 which claims the benefit of U.S. Provisional App. No. 60/868,666, filed Dec. 5, 2006 and U.S. Provisional App. No. 60/971,265, filed Sep. 11, 2007, the contents of all of which are incorporated herein by reference.

FIELD OF THE INVENTION

Described herein are viral and host microRNA molecules associated with viral infections, as well as various nucleic acid molecules relating thereto or derived therefrom.

BACKGROUND OF THE INVENTION

MicroRNAs (miRNAs) are a family of 18-24 nucleotide long non-coding small RNAs, that suppress translation of target genes by binding to their mRNA, thereby regulating the expression of at least 30% of all human genes. Although miRNAs are present in a wide range of species including *C. elegans, Drosophila* and humans, they have only recently been identified. More importantly, the role of miRNAs in the development and progression of disease has only recently become appreciated. There are currently about 500 known human microRNAs, and their number probably exceeds 800.

As a result of their small size, miRNAs have been difficult to identify using standard methodologies. A limited number of miRNAs have been identified by extracting large quantities of RNA. miRNAs have been identified that contribute to the presentation of visibly discernable phenotypes. Expression array data show that miRNAs are expressed in different developmental stages or in different tissues. The restriction of miRNAs to certain tissues or at limited developmental stages indicates that the miRNAs identified to date are likely only a small fraction of the total miRNAs.

Computational approaches have recently been developed to identify the remainder of miRNAs in the genome. Tools such as MiRscan and MiRseeker have identified miRNAs that were later experimentally confirmed. Based on the fundamental importance of miRNAs in mammalian biology and disease, the art needs to identify unknown miRNAs.

Viruses can establish a variety of types of infection. These infections can be generally classified as lytic or persistent, though some lytic infections are considered persistent. Generally, persistent infections fall into two categories: (1) chronic (productive) infection, i.e., infection wherein infectious virus is present and can be recovered by traditional biological methods and (2) latent infection, i.e., infection wherein viral genome is present in the cell but infectious virus is generally not produced except during intermittent episodes of reactivation. Persistence generally involves stages of both productive and latent infection.

Lytic infections can also persist under conditions where only a small fraction of the total cells are infected (smoldering (cycling) infection). The few infected cells release virus and are killed, but the progeny virus again only infect a small number of the total cells.

Traditional treatments for viral infection include pharmaceuticals aimed at specific virus derived proteins, or recombinant (cloned) immune modulators (host derived), such as the interferons. However, the current methods have several limitations and drawbacks which include high rates of viral mutations which render anti-viral pharmaceuticals ineffective. For immune modulators, limited effectiveness, limiting side effects, a lack of specificity all limit the general applicability of these agents. Also the rate of success with current antivirals and immune-modulators has been disappointing.

Viral infections are a continuing medical problem because, like any rapidly-dividing infectious agent, there are continuing mutations that help some sub-populations of viruses continue to be resistant to current treatment regimens. Many virally-based diseases do not have effective anti-viral treatments, because such treatments address the symptoms of the viral disease and not the root cause of the disease. There is a need in the art to discover and develop new anti-viral therapies.

SUMMARY OF THE INVENTION

Provided herein are compositions and methods for the identification, suppression and modulation of viral infection in a target cell. Also provided are pharmaceutical compositions and kits for use in practicing the methods. The compositions and methods may be used in a variety of applications, including the treatment of subjects suffering from a viral mediated disease condition.

Also provided is an isolated nucleic acid comprising a sequence selected from the group consisting of SEQ ID NOS: 1-9,221, 15,366-15,392 and 15,516-15,527; the complementary sequence thereof; and a sequence at least about 80% identical thereto. The nucleic acid may be from 5-250 nucleotides in length. The nucleic acid may comprise a modified base.

Further provided is a probe comprising the nucleic acid. The probe may comprise at least 8-22 contiguous nucleotides complementary to SEQ ID NOS: 1-9,221, 15,366-15,392 and 15,516-15,527, or a variant thereof. The probe may also comprise at least 8-22 contiguous nucleotides complementary to a host microRNA differentially expressed in viral infection, or a variant thereof.

Also provided is a composition comprising the nucleic acid.

Further provided is a biochip comprising the nucleic acid.
Also provided is a vector comprising the nucleic acid.
Further provided is a host cell comprising the nucleic acid.
Also provided is a pharmaceutical composition comprising the nucleic acid as an active ingredient, and a composition comprising the vector.

Further provided is a method of preventing or treating viral infection or a condition associated with a viral infection in a subject in need thereof. The method may comprise administering to the subject an effective amount of a composition comprising a nucleic acid sequence selected from the group consisting of SEQ ID NOS: 1-9,221, 15,366-15,392 and 15,516-15,527; a complementary sequence thereof; and a sequence at least about 80% identical thereto. The viral infection may be caused by a virus selected from the group consisting of: HSV1, HSV2, RSV, EBV, Influenza A, HCV, HPV, HIV, HBV and Vaccinia virus. The condition associated with the viral infection may be selected from the group consisting of: Burkitt's lymphoma, nasopharingal carcinoma, ovarian carcinoma, cervical cancer, hepatitis, mononucleosis, genital herpes, encephalitis, influenza and bronchiolitis.

Also provided is a method for reducing the amount of virus replication in a target cell, where the target cell may be present in vitro or in vivo.

Further provided is the use of a nucleic acid comprising a nucleic acid sequence selected from the group consisting of SEQ ID NOS: 1-9,221, 15,366-15,392 and 15,516-15,527; a complementary sequence thereof; and a sequence at least about 80% identical thereto for the manufacture of a medicament for the treatment or prevention of viral infection.

Also provided is a method for modulating a nucleic acid. The method may comprise modulating a first nucleic acid comprising the nucleotide sequence selected from the group consisting of (a) any one of SEQ ID NOS: 9,222-15,365 and 15,393-15,515, (b) a complementary sequence of (a), and (c) sequence at least about 80% identical to (a) or (b).

The method may further comprise introducing a second nucleic acid to the first nucleic acid wherein the second nucleic acid is selected from the group consisting of (a) SEQ ID NOS: 1-9,221, 15,366-15,392, 15,516-15,527, and (b) sequence at least about 80% identical to (a), wherein the second nucleic acid modulates expression of the first nucleic acid. The first nucleic acid may be a miRNA target gene. The second nucleic acid may be a miRNA or siRNA.

Further provided is a method of inhibiting expression of a target gene in a cell. A nucleic acid may be introduced into the cell in an amount sufficient to inhibit expression of the target gene. The target gene may comprise a binding site substantially identical to SEQ ID NOS: 9,222-15,365 and 15,393-15,515, or a variant thereof. The nucleic acid may comprise a portion of SEQ ID NOS: 1-9,221, 15,366-15,392 and 15,516-15,527 or a variant thereof. Expression of a target gene may be inhibited in vitro or in vivo.

Also provided is a method of detecting viral infection of a cell comprising determining the expression level of a nucleic acid sequence selected from the group consisting of SEQ ID NOS: 1-9,221, 15,366-15,392 and 15,516-15,527; a complementary sequence thereto or a sequence at least about 80% identical thereto. The method of detecting viral infection may comprise a microRNA array, RT-PCR, or Northern blot analysis.

Further provided is a kit comprising the nucleic acid.

Also provided is a method of reducing the amount of virus replication in a target cell, which may comprise introducing an effective amount of a composition into a target cell infected with a virus. The composition may comprise a nucleic acid sequence selected from the group consisting of SEQ ID NOS: 1-9,221, 15,366-15,392 and 15,516-15,527; a complementary sequence thereof; and a sequence at least about 80% identical thereto. The target cell may be in vitro or in vivo. A subject may comprise said target cell. The virus may be HSV1, HSV2, RSV, EBV, Influenza A, HCV, HPV, HIV, HBV, or Vaccinia virus. The method may be used to treat a viral mediated disease condition in a subject in need thereof. The disease condition may be Burkitt's lymphoma, nasopharingal carcinoma, ovarian carcinoma, cervical cancer, hepatitis, mononucleosis, influenza, genital herpes, encephalitis, or bronchiolitis.

BRIEF DESCRIPTION OF THE SEQUENCE LISTING AND TABLES

Incorporated herein by reference are the sequence listing, which is a .txt file named, "Sequence Listing" (2,759 kb, created May 27, 2009); and the tables, which are .txt files named "Table 1" (283 kb), "Table 2" (36 kb),"Table 3" (217 kb),"Table 4" (1 kb),"Table 5" (9 kb),"Table 6" (190 kb),and "Table 7" (2 kb), all of which were created Nov. 29, 2006.

DETAILED DESCRIPTION

Figure 1:
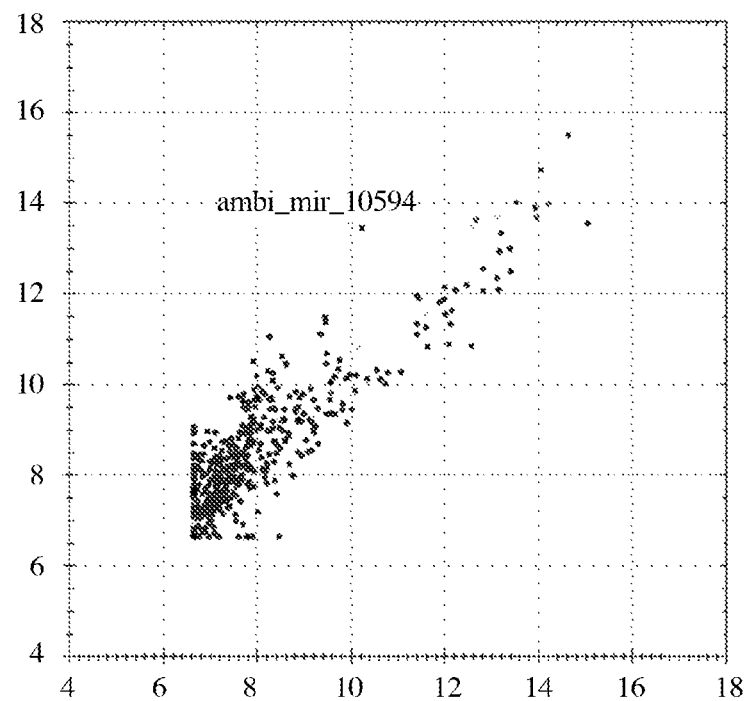
FIG. 1 shows microRNA expression profiling of respiratory syncytial virus (RSV) infected HEp2 cells as compared to uninfected control cells using miRdicator™ microRNA array. The expressed host microRNA AMB-10594 (SEQ ID NO: 15,374) is indicated.

During viral infection, viruses express specific miRNAs and alter host miRNA expression. Provided herein are compositions and methods to prevent or treat viral infection. Identification of specific miRNA signatures and the targets of these miRNAs induced by viruses may be used to identify cellular and viral genes required for viral infection.

The inventors have made the surprising discovery that the expression levels of several viral microRNAs (SEQ ID NOS: 15,375-15,387) and host microRNAs (SEQ ID NOS: 15,366-15,374) were altered following viral infection. Furthermore, different viruses produce distinct microRNAs expression patterns in various viral infected cells.

Specific viral and host miRNA nucleic acids may be used as novel therapeutics in the treatment of viral infections. The nucleic acids also be used in diagnostics for clinical and research settings including detection of latent infections. The disclosed viral and host miRNAs may be used to discover new cellular and viral drugs and drug targets.

Described herein is the expression of viral and host encoded microRNAs in viral infections by HSV1, HSV2, RSV, EBV, Influenza A, HCV, HPV and Vaccinia viruses.

Provided herein are nucleotide sequences of viral, and human miRNAs, precursors thereto, targets thereof and related sequences. Such nucleic acids may be used for diagnostic purposes, therapeutic purposes, and also for modifying target gene expression.

1. Definitions

Before the present compositions and methods are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise. It must further be noted that the terms "and" and "or" may encompass both conjunctive and disjunctive meaning unless the context clearly dictates otherwise.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the numbers 6.0, 6.1, 6.2, 6.3, 6.4, 6.5, 6.6, 6.7, 6.8, 6.9, and 7.0 are explicitly contemplated.

"Animal" as used herein may mean fish, amphibians, reptiles, birds, and mammals, such as mice, rats, rabbits, goats, cats, dogs, cows, apes and humans.

"Attached" or "immobilized" as used herein to refer to a probe and a solid support may mean that the binding between the probe and the solid support is sufficient to be stable under conditions of binding, washing, analysis, and removal. The binding may be covalent or non-covalent. Covalent bonds may be formed directly between the probe and the solid support or may be formed by a cross linker or by inclusion of a specific reactive group on either the solid support or the probe or both molecules. Non-covalent binding may be one or more of electrostatic, hydrophilic, and hydrophobic interactions. Included in non-covalent binding is the covalent attachment of a molecule, such as streptavidin, to the support and the non-covalent binding of a biotinylated probe to the streptavidin Immobilization may also involve a combination of covalent and non-covalent interactions.

"Biological sample" as used herein may mean a sample of biological tissue or fluid that comprises nucleic acids. Such samples include, but are not limited to, tissue isolated from animals. Biological samples may also include sections of tissues such as biopsy and autopsy samples, frozen sections taken for histological purposes, blood, plasma, serum, sputum, stool, tears, mucus, urine, effusions, amniotic fluid, ascitic fluid, hair, and skin. Biological samples also include explants and primary and/or transformed cell cultures derived from patient tissues. A biological sample may be provided by removing a sample of cells from an animal, but can also be accomplished by using previously isolated cells (e.g., isolated by another person, at another time, and/or for another purpose), or by performing the methods described herein in vivo. Archival tissues, such as those having treatment or outcome history, may also be used.

"Complement" or "complementary" as used herein may mean Watson-Crick (e.g., A-T/U and C-G) or Hoogsteen base pairing between nucleotides or nucleotide analogs of nucleic acid molecules. A complement may be identical in length to a nucleic acid disclosed herein.

"Differential expression" may mean qualitative or quantitative differences in the temporal and/or cellular gene expression patterns within and among cells and tissue. Thus, a differentially expressed gene can qualitatively have its expression altered, including an activation or inactivation, in, e.g., normal versus disease tissue. Genes may be turned on or turned off in a particular state, relative to another state thus permitting comparison of two or more states. A qualitatively regulated gene will exhibit an expression pattern within a state or cell type that may be detectable by standard techniques. Some genes will be expressed in one state or cell type, but not in both. Alternatively, the difference in expression may be quantitative, e.g., in that expression is modulated, up-regulated, resulting in an increased amount of transcript, or down-regulated, resulting in a decreased amount of transcript. The degree to which expression differs need only be large enough to quantify via standard characterization techniques such as expression arrays, quantitative reverse transcriptase PCR, northern analysis, and RNase protection.

"Expression profile" as used herein may mean a genomic expression profile, e.g., an expression profile of microRNAs. Profiles may be generated by any convenient means for determining a level of a nucleic acid sequence e.g. quantitative hybridization of microRNA, labeled microRNA, amplified microRNA, cRNA, etc., quantitative PCR, ELISA for quantitation, and the like, and allow the analysis of differential gene expression between two samples. A subject or patient tumor sample, e.g., cells or collections thereof, e.g., tissues, is assayed. Samples are collected by any convenient method, as known in the art. Nucleic acid sequences of interest are nucleic acid sequences that are found to be predictive, including the nucleic acid sequences provided above, where the expression profile may include expression data for 5, 10, 20, 25, 50, 100 or more of, including all of the listed nucleic acid sequences. The term "expression profile" may also mean measuring the abundance of the nucleic acid sequences in the measured samples.

"Gene" used herein may be a genomic gene comprising transcriptional and/or translational regulatory sequences and/or a coding region and/or non-translated sequences (e.g., introns, 5'- and 3'-untranslated sequences). The coding region of a gene may be a nucleotide sequence coding for an amino acid sequence or a functional RNA, such as tRNA, rRNA, catalytic RNA, siRNA, miRNA and antisense RNA. A gene may also be an miRNA or cDNA corresponding to the coding regions (e.g., exons and miRNA) optionally comprising 5'- or 3'-untranslated sequences linked thereto. A gene may also be an amplified nucleic acid molecule produced in vitro comprising all or a part of the coding region and/or 5'- or 3'-untranslated sequences linked thereto.

"Host cell" used herein may mean a naturally occurring cell or a transformed cell that may contain a vector and may support the replication of the vector. Host cells may be cultured cells, explants, cells in vivo, and the like. Host cells may be prokaryotic cells such as E. coli, or eukaryotic cells such as yeast, insect, amphibian, or mammalian cells, such as CHO, HeLa.

"Identical" or "identity" used herein in the context of two or more nucleic acids or polypeptide sequences, may mean that the sequences have a specified percentage of residues that are the same over a specified region. The percentage may be calculated by comparing optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces staggered ends and the specified region of comparison includes only a single sequence, the residues of single sequence are included in the denominator but not the numerator of the calculation. When comparing DNA and RNA, thymine (T) and uracil (U) are considered equivalent. Identity may be performed manually or by using computer sequence algorithm such as BLAST or BLAST 2.0.

"Inhibit" as used herein may mean prevent, suppress, repress, reduce or eliminate.

"Label" as used herein may mean a composition detectable by spectroscopic, photochemical, biochemical, immunochemical, chemical, or other physical means. For example, useful labels include $P^{32}$, fluorescent dyes, electron-dense reagents, enzymes (e.g., as commonly used in an ELISA), biotin, digoxigenin, or haptens and other entities which can be made detectable. A label may be incorporated into nucleic acids and proteins at any position.

"Nucleic acid", "oligonucleotide" or "polynucleotide" used herein may mean at least two nucleotides covalently linked together. The depiction of a single strand also defines the sequence of the complementary strand. Thus, a nucleic acid also encompasses the complementary strand of a depicted single strand. Many variants of a nucleic acid may be used for the same purpose as a given nucleic acid. Thus, a nucleic acid also encompasses substantially identical nucleic acids and complements thereof. A single strand provides a probe that may hybridize to the target sequence under stringent hybridization conditions. Thus, a nucleic acid also encompasses a probe that hybridizes under stringent hybridization conditions.

Nucleic acids may be single stranded or double stranded, or may contain portions of both double stranded and single stranded sequence. The nucleic acid may be DNA, both genomic and cDNA, RNA, or a hybrid, where the nucleic acid may contain combinations of deoxyribo- and ribo-nucleotides, and combinations of bases including uracil, adenine, thymine, cytosine, guanine, inosine, xanthine hypoxanthine, isocytosine and isoguanine. Nucleic acids may be obtained by chemical synthesis methods or by recombinant methods.

A nucleic acid will generally contain phosphodiester bonds, although nucleic acid analogs may be included that may have at least one different linkage, e.g., phosphoramidate, phosphorothioate, phosphorodithioate, or O-methylphosphoroamidite linkages and peptide nucleic acid backbones and linkages. Other analog nucleic acids include those with positive backbones; non-ionic backbones, and non-ribose backbones, including those described in U.S. Pat. Nos. 5,235,033 and 5,034,506, which are incorporated by reference. Nucleic acids containing one or more non-naturally occurring or modified nucleotides are also included within one definition of nucleic acids. The modified nucleotide analog may be located for example at the 5'-end and/or the 3'-end of the nucleic acid molecule. Representative examples of nucleotide analogs may be selected from sugar- or backbone-modified ribonucleotides. It should be noted, however, that also nucleobase-modified ribonucleotides, i.e. ribonucleotides, containing a non-naturally occurring nucleobase instead of a naturally occurring nucleobase such as uridines or cytidines modified at the 5-position, e.g. 5-(2-amino)propyl uridine, 5-bromo uridine; adenosines and guanosines modified at the 8-position, e.g. 8-bromo guanosine; deaza nucleotides, e.g. 7-deaza-adenosine; O- and N-alkylated nucleotides, e.g. N6-methyl adenosine are suitable. The 2'-OH-group may be replaced by a group selected from H, OR, R, halo, SH, SR, $NH_2$, NHR, $NR_2$ or CN, wherein R is $C_1$-$C_6$ alkyl, alkenyl or alkynyl and halo is F, Cl, Br or I. The nucleic acid may comprise a 2'-ribose replacement such as a 2'-O-methyl and 2'-fluoro group, as described in U.S. Pat. No. 7,138,517, the contents of which are incorporated herein by reference. Modified nucleotides also include nucleotides conjugated with cholesterol through a hydroxyprolinol linkage as described in Krutzfeldt et al., Nature 438:685-689 (2005), Soutschek et al., Nature 432:173-178 (2004), and U.S. Patent Publication No. 20050107325, which are incorporated herein by reference. Modified nucleotides and nucleic acids may also include locked nucleic acids (LNA), as described in U.S. Patent No. 20020115080, which is incorporated herein by reference. Additional modified nucleotides and nucleic acids are described in U.S. Patent Publication No. 20050182005, which is incorporated herein by reference. Modifications of the ribose-phosphate backbone may be done for a variety of reasons, e.g., to increase the stability and half-life of such molecules in physiological environments or as probes on a biochip. Mixtures of naturally occurring nucleic acids and analogs may be made; alternatively, mixtures of different nucleic acid analogs, and mixtures of naturally occurring nucleic acids and analogs may be made.

"Operably linked" used herein may mean that expression of a gene is under the control of a promoter with which it is spatially connected. A promoter may be positioned 5' (upstream) or 3' (downstream) of a gene under its control. The distance between the promoter and the gene may be approximately the same as the distance between that promoter and the gene it controls in the gene from which the promoter is derived. As is known in the art, variation in this distance may be accommodated without loss of promoter function.

"Probe" as used herein may mean an oligonucleotide capable of binding to a target nucleic acid of complementary sequence through one or more types of chemical bonds, usually through complementary base pairing, usually through hydrogen bond formation. Probes may bind target sequences lacking complete complementarity with the probe sequence depending upon the stringency of the hybridization conditions. There may be any number of base pair mismatches that will interfere with hybridization between the target sequence and a single stranded nucleic acid described herein. However, if the number of mismatches is so great that no hybridization can occur under even the least stringent of hybridization conditions, the sequence is not a complementary target sequence. A probe may be single stranded or partially single and partially double stranded. The strandedness of the probe is dictated by the structure, composition, and properties of the target sequence. Probes may be directly labeled or indirectly labeled such as with biotin to which a streptavidin complex may later bind.

"Promoter" as used herein may mean a synthetic or naturally-derived molecule which is capable of conferring, activating or enhancing expression of a nucleic acid in a cell. A promoter may comprise one or more specific regulatory elements to further enhance expression and/or to alter the spatial expression and/or temporal expression of same. A promoter may also comprise distal enhancer or repressor elements, which can be located as much as several thousand base pairs from the start site of transcription. A promoter may be derived from sources including viral, bacterial, fungal, plants, insects, and animals. A promoter may regulate the expression of a gene component constitutively or differentially with respect to cell, the tissue or organ in which expression occurs or, with respect to the developmental stage at which expression occurs, or in response to external stimuli such as physiological stresses, pathogens, metal ions, or inducing agents. Representative examples of promoters include the bacteriophage T7 promoter, bacteriophage T3 promoter, SP6 promoter, lac operator-promoter, tac promoter, SV40 late promoter, SV40 early promoter, RSV-LTR promoter, CMV IE promoter, SV40 early promoter or SV40 late promoter and the CMV IE promoter.

"Reducing the amount of virus replication" used herein may mean that the level or quantity of the target viral genome in the target cell is reduced by at least about 2-fold to 100-fold or more, as compared to a control, i.e., an identical target cell not treated according to the subject methods.

"Selectable marker" used herein may mean any gene which confers a phenotype on a cell in which it is expressed to facilitate the identification and/or selection of cells which are transfected or transformed with a genetic construct. Representative examples of selectable markers include the ampicillin-resistance gene ($Amp^r$), tetracycline-resistance gene ($Tc^r$), bacterial kanamycin-resistance gene ($Kan^r$), zeocin resistance gene, the AURI-C gene which confers resistance to the antibiotic aureobasidin A, phosphinothricin-resistance gene, neomycin phosphotransferase gene (nptII), hygromycin-resistance gene, beta-glucuronidase (GUS) gene, chloramphenicol acetyltransferase (CAT) gene, green fluorescent protein-encoding gene and luciferase gene.

"Stringent hybridization conditions" used herein may mean conditions under which a first nucleic acid sequence (e.g., probe) will hybridize to a second nucleic acid sequence (e.g., target), such as in a complex mixture of nucleic acids. Stringent conditions are sequence-dependent and will be different in different circumstances. Generally, stringent conditions may be selected to be about 5-10° C. lower than the thermal melting point ($T_m$) for the specific sequence at a defined ionic strength pH. The $T_m$ may be the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may be those in which the salt concentration is less than about 1.0 M sodium ion, such as about 0.01-1.0 M sodium ion concentration (or other salts) at pH 7.0 to 8.3 and the temperature is at least about 30° C. for short probes (e.g., about 10-50 nucleotides) and at least about 60° C. for long probes (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

"Substantially complementary" used herein may mean that a first sequence is at least 60%-99% identical to the complement of a second sequence over a region of 8-50 or more nucleotides, or that the two sequences hybridize under stringent hybridization conditions.

"Substantially identical" used herein may mean that a first and second sequence are at least 60%-99% identical over a region of 8-50 or more nucleotides or amino acids, or with respect to nucleic acids, if the first sequence is substantially complementary to the complement of the second sequence.

"Subject" used herein may mean a mammal, such as a human.

"Target" as used herein may mean a polynucleotide that may be bound by one or more probes under stringent hybridization conditions.

"Terminator" used herein may mean a sequence at the end of a transcriptional unit which signals termination of transcription. A terminator may be a 3'-non-translated DNA sequence containing a polyadenylation signal, which may facilitate the addition of polyadenylate sequences to the 3'-end of a primary transcript. A terminator may be derived from sources including viral, bacterial, fungal, plants, insects, and animals. Representative examples of terminators include the SV40 polyadenylation signal, HSV TK polyadenylation signal, CYC1 terminator, ADH terminator, SPA terminator, nopaline synthase (NOS) gene terminator of *Agrobacterium tumefaciens*, the terminator of the Cauliflower mosaic virus (CaMV) 35S gene, the zein gene terminator from *Zea mays*, the Rubisco small subunit gene (SSU) gene terminator sequences, subclover stunt virus (SCSV) gene sequence terminators, rho-independent *E. coli* terminators, and the lacZ alpha terminator.

"Treat" or "treating" used herein when referring to protection of an animal from a condition may mean preventing, suppressing, repressing, or eliminating the condition. Preventing the condition involves administering a composition described herein to an animal prior to onset of the condition. Suppressing the condition involves administering the composition to an animal after induction of the condition but before its clinical appearance. Repressing the condition involves administering the composition to an animal after clinical appearance of the condition such that the condition is reduced or prevented from worsening. Elimination of the condition involves administering the composition to an animal after clinical appearance of the condition such that the animal no longer suffers from the condition.

"Therapeutically effective amount" used herein or "therapeutically efficient" as to a drug dosage may refer to dosage that provides the specific pharmacological response for which the drug is administered in a significant number of subjects in need of such treatment. The "therapeutically effective amount" may vary according, for example, the physical condition of the patient, the age of the patient and the severity of the disease.

"Unit dosage form," used herein may refer to a physically discrete unit suitable as a unitary dosage for a human or animal subject. Each unit may contain a predetermined quantity of a composition described herein, calculated in an amount sufficient to produce a desired effect in association with a pharmaceutically acceptable diluent, carrier or vehicle. The specifications for a unit dosage form may depend on the particular composition employed and the effect to be achieved, and the pharmacodynamics associated with the composition in the host.

"Variant" used herein to refer to a nucleic acid may mean (i) a portion of a referenced nucleotide sequence; (ii) the complement of a referenced nucleotide sequence or portion thereof; (iii) a nucleic acid that is substantially identical to a referenced nucleic acid or the complement thereof; or (iv) a nucleic acid that hybridizes under stringent conditions to the referenced nucleic acid, complement thereof, or a sequences substantially identical thereto.

"Vector" used herein may mean a nucleic acid sequence containing an origin of replication. A vector may be a plasmid, bacteriophage, bacterial artificial chromosome or yeast artificial chromosome. A vector may be a DNA or RNA vector. A vector may be either a self-replicating extrachromosomal vector or a vector that integrates into a host genome.

"Wild type" used herein to refer to a sequence may mean a coding, non-coding or interface sequence that may be an allelic form of a sequence that performs the natural or normal function for that sequence. Wild type sequences may include multiple allelic forms of a cognate sequence, for example, multiple alleles of a wild type sequence may encode silent or conservative changes to the protein sequence that a coding sequence encodes.

2. MicroRNA

While not being bound by theory, a gene coding for a miRNA may be transcribed leading to production of an miRNA precursor known as the pri-miRNA. The pri-miRNA may be part of a polycistronic RNA comprising multiple pri-miRNAs. The pri-miRNA may form a hairpin with a stem and loop. The stem may comprise mismatched bases.

The hairpin structure of the pri-miRNA may be recognized by Drosha, which is an RNase III endonuclease. Drosha may recognize terminal loops in the pri-miRNA and cleave approximately two helical turns into the stem to produce a 30 200 nt precursor known as the pre-miRNA. Drosha may cleave the pri-miRNA with a staggered cut typical of RNase III endonucleases yielding a pre-miRNA stem loop with a 5' phosphate and ~2 nucleotide 3' overhang. Approximately one helical turn of the stem (~10 nucleotides) extending beyond the Drosha cleavage site may be essential for efficient processing. The pre-miRNA may then be actively transported from the nucleus to the cytoplasm by Ran-GTP and the export receptor Ex-portin-5.

The pre-miRNA may be recognized by Dicer, which is also an RNase III endonuclease. Dicer may recognize the double-stranded stem of the pre-miRNA. Dicer may also recognize the 5' phosphate and 3' overhang at the base of the stem loop. Dicer may cleave off the terminal loop two helical turns away from the base of the stem loop leaving an additional 5' phosphate and ~2 nucleotide 3' overhang. The resulting siRNA-like duplex, which may comprise mismatches, comprises the mature miRNA and a similar-sized fragment known as the miRNA*. The miRNA and miRNA* may be derived from opposing arms of the pri-miRNA and pre-miRNA. MiRNA* sequences may be found in libraries of cloned miRNAs but typically at lower frequency than the miRNAs.

Although initially present as a double-stranded species with miRNA*, the miRNA may eventually become incorporated as a single-stranded RNA into a ribonucleoprotein complex known as the RNA-induced silencing complex (RISC). Various proteins can form the RISC, which can lead to variability in the specificity for miRNA/miRNA* duplexes, the binding site of the target gene, the activity of the miRNA (repress or activate), and which strand of the miRNA/miRNA* duplex is loaded in to the RISC.

When the miRNA strand of the miRNA:miRNA* duplex is loaded into the RISC, the miRNA* may be removed and degraded. The strand of the miRNA:miRNA* duplex that is loaded into the RISC may be the strand whose 5' end is less tightly paired. In cases where both ends of the miRNA:miRNA* have roughly equivalent 5' pairing, both miRNA and miRNA* may have gene silencing activity.

The RISC may identify target nucleic acids based on high levels of complementarity between the miRNA and the mRNA, especially by nucleotides 2-8 of the miRNA. Only one case has been reported in animals where the interaction between the miRNA and its target was along the entire length of the miRNA. This was shown for mir-196 and Hox B8 and it was further shown that mir-196 mediates the cleavage of the Hox B8 mRNA (Yekta et al 2004, Science 304-594). Otherwise, such interactions are known only in plants (Bartel & Bartel 2003, Plant Physiol 132-709).

A number of studies have looked at the base-pairing requirement between miRNA and its mRNA target for achieving efficient inhibition of translation (reviewed by Bartel 2004, Cell 116-281). In mammalian cells, the first 8 nucleotides of the miRNA may be important (Doench & Sharp 2004 GenesDev 2004-504). However, other parts of the microRNA may also participate in mRNA binding. Moreover, sufficient base pairing at the 3' end can compensate for insufficient pairing at the 5' end (Brennecke et al, 2005 PLoS 3-e85). Computation studies, analyzing miRNA binding on whole genomes have suggested a specific role for bases 2-7 at the 5' end of the miRNA in target binding but the role of the first nucleotide, found usually to be "A" was also recognized (Lewis et at 2005 Cell 120-15). Similarly, nucleotides 1-7 or 2-8 were used to identify and validate targets by Krek et al (2005, Nat Genet 37-495).

The target sites in the mRNA may be in the 5' UTR, the 3' UTR or in the coding region. Interestingly, multiple miRNAs may regulate the same mRNA target by recognizing the same or multiple sites. The presence of multiple miRNA binding sites in most genetically identified targets may indicate that the cooperative action of multiple RISCs provides the most efficient translational inhibition.

MiRNAs may direct the RISC to downregulate gene expression by either of two mechanisms: mRNA cleavage or translational repression. The miRNA may specify cleavage of the mRNA if the mRNA has a certain degree of complementarity to the miRNA. When a miRNA guides cleavage, the cut may be between the nucleotides pairing to residues 10 and 11 of the miRNA. Alternatively, the miRNA may repress translation if the miRNA does not have the requisite degree of complementarity to the miRNA. Translational repression may be more prevalent in animals since animals may have a lower degree of complementarity between the miRNA and the binding site.

It should be noted that there may be variability in the 5' and 3' ends of any pair of miRNA and miRNA*. This variability may be due to variability in the enzymatic processing of Drosha and Dicer with respect to the site of cleavage. Variability at the 5' and 3' ends of miRNA and miRNA* may also be due to mismatches in the stem structures of the pri-miRNA and pre-miRNA. The mismatches of the stem strands may lead to a population of different hairpin structures. Variability in the stem structures may also lead to variability in the products of cleavage by Drosha and Dicer.

3. Nucleic Acid

A nucleic acid is provided herein. The nucleic acid may comprise the sequence of any one of SEQ ID NOS: 1-15,527 or a variant thereof. The variant may be a complement of the referenced nucleotide sequence. The variant may also be a nucleotide sequence that is substantially identical to the referenced nucleotide sequence or the complement thereof. The variant may also be a nucleotide sequence which hybridizes under stringent conditions to the referenced nucleotide sequence, complements thereof, or nucleotide sequences substantially identical thereto. The nucleic acid may have a length of at least 10-250 nucleotides. The nucleic acid may comprise a modified base. The nucleic acid may be synthesized or expressed in a cell (in vitro or in vivo) using a synthetic gene described herein. The nucleic acid may be synthesized as a single strand molecule and hybridized to a substantially complementary nucleic acid to form a duplex.

LENGTHY TABLES

The patent contains a lengthy table section. A copy of the table is available in electronic form from the USPTO web site (http://seqdata.uspto.gov/?pageRequest=docDetail&DocID=US08481506B2). An electronic copy of the table will also be available from the USPTO upon request and payment of the fee set forth in 37 CFR 1.19(b)(3).

a. Nucleic acid complex

The nucleic acid may further comprise one or more of the following: a peptide, a protein, a RNA-DNA hybrid, an antibody, an antibody fragment, a Fab fragment, and an aptamer.

b. Pri-miRNA

The nucleic acid may comprise a sequence of a pri-miRNA or a variant thereof. The pri-miRNA sequence may comprise from 45-30,000, 50-25,000, 100-20,000, 1,000-1,500 or 80-100 nucleotides. The sequence of the pri-miRNA may comprise a pre-miRNA, miRNA and miRNA*, as set forth herein, and variants thereof. The sequence of the pri-miRNA may comprise the sequence of any one of SEQ ID NOS: 1-15,527 or a variant thereof.

The pri-miRNA may form a hairpin structure. The hairpin may comprise first and second nucleic acid sequence that are substantially complementary. The first and second nucleic acid sequence may be from 37-50 nucleotides. The first and second nucleic acid sequence may be separated by a third sequence of from 8-12 nucleotides. The hairpin structure may have a free energy less than −25 Kcal/mole as calculated by the Vienna algorithm with default parameters, as described in Hofacker et al., Monatshefte f. Chemie 125: 167-188 (1994), the contents of which are incorporated herein. The hairpin may comprise a terminal loop of 4-20, 8-12 or 10 nucleotides. The pri-miRNA may comprise at least 19% adenosine nucleotides, at least 16% cytosine nucleotides, at least 23% thymine nucleotides and at least 19% guanine nucleotides.

c. Pre-miRNA

The nucleic acid may also comprise a sequence of a pre-miRNA or a variant thereof. The pre-miRNA sequence may comprise from 45-200, 60-80 or 60-70 nucleotides. The sequence of the pre-miRNA may comprise a miRNA and a miRNA* as set forth herein. The sequence of the pre-miRNA may also be that of a pri-miRNA excluding from 0-160 nucleotides from the 5' and 3' ends of the pri-miRNA. The sequence of the pre-miRNA may comprise the sequence of any one of SEQ ID NOS: 1-15,527 or a variant thereof.

d. MiRNA

The nucleic acid may also comprise a sequence of a miRNA (including miRNA*) or a variant thereof. The miRNA sequence may comprise from 13-33, 18-24 or 21-23 nucleotides. The miRNA may also comprise a total of at least 5-40 nucleotides. The sequence of the miRNA may be the first 13-33 nucleotides of the pre-miRNA. The sequence of the miRNA may also be the last 13-33 nucleotides of the pre-miRNA. The sequence of the miRNA may be differentially expressed during a viral infection, and may comprise the sequence of any one of SEQ ID NOS: 1-9,221, 15,366-15,392, 15,516-15,527, or a variant thereof as indicated in Table 1 and Table 8.

TABLE 8

The host and viral microRNAs which were differentially expressed upon viral infection

| MID | HIDs | microRNA name | Organism |
|---|---|---|---|
| 15,366 | 15,379 | hsa-miR-181a | *Homo sapiens* |
| 15,367 | 15,380 | hsa-miR-193a | *Homo sapiens* |
| 15,368 | 15,381 | hsa-miR-107 | *Homo sapiens* |
| 15,369 | 15,382 | hsa-miR-103 | *Homo sapiens* |
| 15,370 | 15,383 | hsa-miR-296 | *Homo sapiens* |
| 15,371 | 15,384 | hsa-miR-574 | *Homo sapiens* |
| 15,372 | 15,385 | hsa-miR-210 | *Homo sapiens* |
| 15,373 | 15,386 | hsa-miR-21 | *Homo sapiens* |
| 15,374 | 15,387 | RG__AMB_10594 | *Homo sapiens* |
| 15,375 | 15,388 | hsv1-miR-H1 | Human herpesvirus 1 |
| 15,376 | 15,389 15,392 | RG__HSV2__Pred13 | Human herpesvirus 2 |
| 15,377 | 15,389 15,392 | RG__HSV2__8 | Human herpesvirus 2 |
| 15,378 | 15,390 15,391 | RG__fluA12 | Influenza A virus |

MID: SEQ ID NO of the mature microRNA sequence
HIDs: SEQ ID NO(S) of the hairpin microRNA precursor
microRNA name: The miRBase registry Sanger 9.2 microRNA name, excluding cases in which the names begins with "RG". In these cases the names are internal miRNA names of Rosetta Genomics.
Organism: The microRNA organism.

e. Anti-miRNA

The nucleic acid may also comprise a sequence of an anti-miRNA that is capable of blocking the activity of a miRNA or miRNA*, such as by binding to the pri-miRNA, pre-miRNA, miRNA or miRNA* (e.g. antisense or RNA silencing), or by binding to the target binding site. The anti-miRNA may comprise a total of 5-100 or 10-60 nucleotides. The anti-miRNA may also comprise a total of at least 5-40 nucleotides. The sequence of the anti-miRNA may comprise (a) at least 5 nucleotides that are substantially identical or complementary to the 5' of a miRNA and at least 5-12 nucleotides that are substantially complementary to the flanking regions of the target site from the 5' end of the miRNA, or (b) at least 5-12 nucleotides that are substantially identical or complementary to the 3' of a miRNA and at least 5 nucleotide that are substantially complementary to the flanking region of the target site from the 3' end of the miRNA. The sequence of the anti-miRNA may comprise the complement of any one of SEQ ID NOS: 1-15,527 or a variant thereof.

f. Binding Site of Target

The nucleic acid may also comprise a sequence of a target microRNA binding site, or a variant thereof. The target site sequence may comprise a total of 5-100 or 10-60 nucleotides. The target site sequence may also comprise a total of at least 5-63 nucleotides. The target site sequence may comprise at least 5 nucleotides of the sequence of any one of SEQ ID NOS: 9,222-15,365 and 15,393-15,515 as indicated in Tables 3 and 9.

TABLE 9

The miRNAs and their predicted binding sites

| microRNA name | MID | Organism | Target gene name | BS SEQ ID NO | Gene Ontology ID |
|---|---|---|---|---|---|
| hsa-miR-181a | 15,366 | *Homo sapiens* | BCL2 | 15,436 | GO:0006959 |
| hsa-miR-181a | 15,366 | *Homo sapiens* | BCL2 | 15,436 | GO:0051607 |
| hsa-miR-181a | 15,366 | *Homo sapiens* | CARD11 | 15,416 | GO:0050776 |
| hsa-miR-181a | 15,366 | *Homo sapiens* | CBLB | 15,506 | GO:0006955 |
| hsa-miR-181a | 15,366 | *Homo sapiens* | CCL8 | 15,477 | GO:0006955 |
| hsa-miR-181a | 15,366 | *Homo sapiens* | CCL8 | 15,477 | GO:0009615 |
| hsa-miR-181a | 15,366 | *Homo sapiens* | CD4 | 15,471 | GO:0006955 |
| hsa-miR-181a | 15,366 | *Homo sapiens* | CD59 | 15,450 | GO:0006955 |
| hsa-miR-181a | 15,366 | *Homo sapiens* | CXCL5 | 15,419 | GO:0006955 |
| hsa-miR-181a | 15,366 | *Homo sapiens* | ETS1 | 15,499 | GO:0006955 |
| hsa-miR-181a | 15,366 | *Homo sapiens* | FAS | 15,502 | GO:0006955 |
| hsa-miR-181a | 15,366 | *Homo sapiens* | GBP6 | 15,489 | GO:0006955 |
| hsa-miR-181a | 15,366 | *Homo sapiens* | IFNA17 | 15,511 | GO:0009615 |
| hsa-miR-181a | 15,366 | *Homo sapiens* | IL2 | 15,483 | GO:0006955 |
| hsa-miR-181a | 15,366 | *Homo sapiens* | LIF | 15,400 | GO:0006955 |
| hsa-miR-181a | 15,366 | *Homo sapiens* | MS4A1 | 15,494 | GO:0006955 |
| hsa-miR-181a | 15,366 | *Homo sapiens* | MS4A1 | 15,497 | GO:0006955 |
| hsa-miR-181a | 15,366 | *Homo sapiens* | OPRK1 | 15,425 | GO:0006955 |
| hsa-miR-181a | 15,366 | *Homo sapiens* | POLA | 15,453 | GO:0009615 |
| hsa-miR-181a | 15,366 | *Homo sapiens* | SAMHD1 | 15,399 | GO:0006955 |
| hsa-miR-181a | 15,366 | *Homo sapiens* | SEMA3C | 15,393 | GO:0006955 |
| hsa-miR-181a | 15,366 | *Homo sapiens* | TNF | 15,428 | GO:0006959 |
| hsa-miR-181a | 15,366 | *Homo sapiens* | TNF | 15,428 | GO:0009615 |
| hsa-miR-181a | 15,366 | *Homo sapiens* | TNFAIP1 | 15,455 | GO:0006955 |
| hsa-miR-181a | 15,366 | *Homo sapiens* | TNFSF4 | 15,496 | GO:0006955 |
| hsa-miR-193a | 15,367 | *Homo sapiens* | CD97 | 15,468 | GO:0006955 |
| hsa-miR-193a | 15,367 | *Homo sapiens* | TNFAIP1 | 15,495 | GO:0006955 |
| hsa-miR-107 | 15,368 | *Homo sapiens* | ARL6IP2 | 15,446 | GO:0006955 |
| hsa-miR-107 | 15,368 | *Homo sapiens* | BST1 | 15,395 | GO:0006959 |
| hsa-miR-107 | 15,368 | *Homo sapiens* | CCL13 | 15,460 | GO:0006955 |
| hsa-miR-107 | 15,368 | *Homo sapiens* | EBI2 | 15,456 | GO:0006955 |
| hsa-miR-107 | 15,368 | *Homo sapiens* | FCGR2A | 15,487 | GO:0006955 |
| hsa-miR-107 | 15,368 | *Homo sapiens* | FCGR2B | 15,488 | GO:0006955 |
| hsa-miR-107 | 15,368 | *Homo sapiens* | IFIT1L | 15,426 | GO:0006955 |
| hsa-miR-107 | 15,368 | *Homo sapiens* | IFNAR1 | 15,516 | GO:0009615 |
| hsa-miR-107 | 15,368 | *Homo sapiens* | IL15 | 15,421 | GO:0006955 |
| hsa-miR-107 | 15,368 | *Homo sapiens* | IL16 | 15,447 | GO:0006955 |
| hsa-miR-107 | 15,368 | *Homo sapiens* | IL1RAP | 15,402 | GO:0006955 |
| hsa-miR-107 | 15,368 | *Homo sapiens* | MICB | 15,433 | GO:0006955 |
| hsa-miR-107 | 15,368 | *Homo sapiens* | OAS3 | 15,444 | GO:0006955 |
| hsa-miR-107 | 15,368 | *Homo sapiens* | SPON2 | 15,462 | GO:0006955 |
| hsa-miR-107 | 15,368 | *Homo sapiens* | TNF | 15,424 | GO:0006959 |
| hsa-miR-107 | 15,368 | *Homo sapiens* | TNF | 15,424 | GO:0009615 |
| hsa-miR-103 | 15,369 | *Homo sapiens* | ARL6IP2 | 15,446 | GO:0006955 |
| hsa-miR-103 | 15,369 | *Homo sapiens* | BST1 | 15,395 | GO:0006959 |
| hsa-miR-103 | 15,369 | *Homo sapiens* | CCL13 | 15,460 | GO:0006955 |
| hsa-miR-103 | 15,369 | *Homo sapiens* | EBI2 | 15,456 | GO:0006955 |
| hsa-miR-103 | 15,369 | *Homo sapiens* | FCGR2A | 15,487 | GO:0006955 |
| hsa-miR-103 | 15,369 | *Homo sapiens* | FCGR2B | 15,488 | GO:0006955 |
| hsa-miR-103 | 15,369 | *Homo sapiens* | IFIT1L | 15,426 | GO:0006955 |
| hsa-miR-103 | 15,369 | *Homo sapiens* | IFNAR1 | 15,516 | GO:0009615 |
| hsa-miR-103 | 15,369 | *Homo sapiens* | IL15 | 15,421 | GO:0006955 |
| hsa-miR-103 | 15,369 | *Homo sapiens* | IL16 | 15,447 | GO:0006955 |
| hsa-miR-103 | 15,369 | *Homo sapiens* | IL1RAP | 15,402 | GO:0006955 |
| hsa-miR-103 | 15,369 | *Homo sapiens* | MICB | 15,433 | GO:0006955 |
| hsa-miR-103 | 15,369 | *Homo sapiens* | OAS3 | 15,444 | GO:0006955 |
| hsa-miR-103 | 15,369 | *Homo sapiens* | SPON2 | 15,462 | GO:0006955 |
| hsa-miR-103 | 15,369 | *Homo sapiens* | TNF | 15,424 | GO:0006959 |
| hsa-miR-103 | 15,369 | *Homo sapiens* | TNF | 15,424 | GO:0009615 |
| hsa-miR-296 | 15,370 | *Homo sapiens* | CD22 | 15,397 | GO:0006955 |
| hsa-miR-296 | 15,370 | *Homo sapiens* | CD6 | 15,405 | GO:0006955 |
| hsa-miR-296 | 15,370 | *Homo sapiens* | CD6 | 15,440 | GO:0006955 |
| hsa-miR-296 | 15,370 | *Homo sapiens* | CD8A | 15,466 | GO:0006955 |
| hsa-miR-296 | 15,370 | *Homo sapiens* | CXCL10 | 15,501 | GO:0006955 |
| hsa-miR-296 | 15,370 | *Homo sapiens* | GBP4 | 15,490 | GO:0006955 |
| hsa-miR-296 | 15,370 | *Homo sapiens* | GCK | 15,464 | GO:0006955 |
| hsa-miR-296 | 15,370 | *Homo sapiens* | HLA-DOA | 15,415 | GO:0006955 |
| hsa-miR-296 | 15,370 | *Homo sapiens* | LAT2 | 15,396 | GO:0006955 |
| hsa-miR-296 | 15,370 | *Homo sapiens* | LIF | 15,470 | GO:0006955 |
| hsa-miR-296 | 15,370 | *Homo sapiens* | MAP4K2 | 15,439 | GO:0006955 |
| hsa-miR-296 | 15,370 | *Homo sapiens* | PVRL1 | 15,465 | GO:0006955 |
| hsa-miR-296 | 15,370 | *Homo sapiens* | SQSTM1 | 15,475 | GO:0006955 |
| hsa-miR-296 | 15,370 | *Homo sapiens* | TNFSF15 | 15,504 | GO:0006955 |
| hsa-miR-296 | 15,370 | *Homo sapiens* | VIPR1 | 15,458 | GO:0006955 |
| hsa-miR-574 | 15,371 | *Homo sapiens* | IL28RA | 15,486 | GO:0050691 |

TABLE 9-continued

The miRNAs and their predicted binding sites

| microRNA name | MID | Organism | Target gene name | BS SEQ ID NO | Gene Ontology ID |
|---|---|---|---|---|---|
| hsa-miR-210 | 15,372 | *Homo sapiens* | CD59 | 15,406 | GO:0006955 |
| hsa-miR-21 | 15,373 | *Homo sapiens* | CCL1 | 15,513 | GO:0006955 |
| hsa-miR-21 | 15,373 | *Homo sapiens* | CCL20 | 15,512 | GO:0006955 |
| hsa-miR-21 | 15,373 | *Homo sapiens* | CTSC | 15,418 | GO:0006955 |
| hsa-miR-21 | 15,373 | *Homo sapiens* | FASLG | 15,401 | GO:0006955 |
| hsa-miR-21 | 15,373 | *Homo sapiens* | IL12A | 15,515 | GO:0006955 |
| hsa-miR-21 | 15,373 | *Homo sapiens* | LILRB4 | 15,430 | GO:0006955 |
| hsa-miR-21 | 15,373 | *Homo sapiens* | PAG1 | 15,482 | GO:0006955 |
| hsa-miR-21 | 15,373 | *Homo sapiens* | ST6GAL1 | 15,484 | GO:0006959 |
| AMB__10594 | 15,374 | *Homo sapiens* | C5AR1 | 15,445 | GO:0006955 |
| AMB__10594 | 15,374 | *Homo sapiens* | CD74 | 15,461 | GO:0006955 |
| AMB__10594 | 15,374 | *Homo sapiens* | CD79B | 15,437 | GO:0006955 |
| AMB__10594 | 15,374 | *Homo sapiens* | CX3CL1 | 15,413 | GO:0006955 |
| AMB__10594 | 15,374 | *Homo sapiens* | DBNL | 15,451 | GO:0006955 |
| AMB__10594 | 15,374 | *Homo sapiens* | HLA-DOA | 15,435 | GO:0006955 |
| AMB__10594 | 15,374 | *Homo sapiens* | IFITM1 | 15,442 | GO:0006955 |
| AMB__10594 | 15,374 | *Homo sapiens* | IL1R1 | 15,474 | GO:0006955 |
| AMB__10594 | 15,374 | *Homo sapiens* | IL6ST | 15,427 | GO:0006955 |
| AMB__10594 | 15,374 | *Homo sapiens* | MBP | 15,443 | GO:0006955 |
| AMB__10594 | 15,374 | *Homo sapiens* | MS4A2 | 15,478 | GO:0006959 |
| AMB__10594 | 15,374 | *Homo sapiens* | NCR3 | 15,459 | GO:0006955 |
| AMB__10594 | 15,374 | *Homo sapiens* | TNFSF8 | 15,414 | GO:0006955 |
| AMB__10594 | 15,374 | *Homo sapiens* | TOLLIP | 15,411 | GO:0006955 |
| hsv1-miR-H1 | 15,375 | Human herpesvirus 1 | ADA | 15,448 | GO:0006955 |
| hsv1-miR-H1 | 15,375 | Human herpesvirus 1 | ANXA11 | 15,409 | GO:0006955 |
| hsv1-miR-H1 | 15,375 | Human herpesvirus 1 | CXCL9 | 15,473 | GO:0006955 |
| hsv1-miR-H1 | 15,375 | Human herpesvirus 1 | HLA-DOB | 15,469 | GO:0006955 |
| hsv1-miR-H1 | 15,375 | Human herpesvirus 1 | IFIT5 | 15,423 | GO:0006955 |
| hsv1-miR-H1 | 15,375 | Human herpesvirus 1 | OASL | 15,412 | GO:0006955 |
| hsv1-miR-H1 | 15,375 | Human herpesvirus 1 | POU2AF1 | 15,441 | GO:0006959 |
| hsv1-miR-H1 | 15,375 | Human herpesvirus 1 | PTGER4 | 15,420 | GO:0006955 |
| hsv1-miR-H1 | 15,375 | Human herpesvirus 1 | SERPINB4 | 15,505 | GO:0006955 |
| hsv1-miR-H1 | 15,375 | Human herpesvirus 1 | SLA2 | 15,454 | GO:0050776 |
| hsv1-miR-H1 | 15,375 | Human herpesvirus 1 | ST6GAL1 | 15,422 | GO:0006959 |
| hsv1-miR-H1 | 15,375 | Human herpesvirus 1 | TCF1 | 15,498 | GO:0006955 |
| HSV2__Pred13 | 15,376 | Human herpesvirus 2 | CD24 | 15,480 | GO:0006959 |
| HSV2__Pred13 | 15,376 | Human herpesvirus 2 | IL16 | 15,493 | GO:0006955 |
| HSV2__Pred13 | 15,376 | Human herpesvirus 2 | IL1A | 15,431 | GO:0006955 |
| HSV2__Pred13 | 15,376 | Human herpesvirus 2 | IL1RL1 | 15,434 | GO:0006955 |
| HSV2__Pred13 | 15,376 | Human herpesvirus 2 | MBP | 15,507 | GO:0006955 |
| HSV2__Pred13 | 15,376 | Human herpesvirus 2 | OLR1 | 15,394 | GO:0006955 |
| HSV2__Pred13 | 15,376 | Human herpesvirus 2 | TNFAIP1 | 15,403 | GO:0006955 |
| HSV2__Pred13 | 15,376 | Human herpesvirus 2 | TRIM5 | 15,404 | GO:0009615 |
| HSV2__Pred13 | 15,376 | Human herpesvirus 2 | VIPR1 | 15,410 | GO:0006955 |
| HSV2__8 | 15,377 | Human herpesvirus 2 | ABCE1 | 15,472 | GO:0009615 |
| HSV2__8 | 15,377 | Human herpesvirus 2 | CAST | 15,514 | GO:0006955 |
| HSV2__8 | 15,377 | Human herpesvirus 2 | CCL20 | 15,429 | GO:0006955 |
| HSV2__8 | 15,377 | Human herpesvirus 2 | CCR2 | 15,476 | GO:0006955 |
| HSV2__8 | 15,377 | Human herpesvirus 2 | CXCL3 | 15,417 | GO:0006955 |
| HSV2__8 | 15,377 | Human herpesvirus 2 | DUOX2 | 15,408 | GO:0009615 |
| fluA12 | 15,378 | Influenza A virus | C19orf2 | 15,479 | GO:0009615 |
| fluA12 | 15,378 | Influenza A virus | CAST | 15,467 | GO:0006955 |
| fluA12 | 15,378 | Influenza A virus | CBLB | 15,509 | GO:0006955 |
| fluA12 | 15,378 | Influenza A virus | CCL8 | 15,438 | GO:0006955 |
| fluA12 | 15,378 | Influenza A virus | CCL8 | 15,438 | GO:0009615 |
| fluA12 | 15,378 | Influenza A virus | CCR9 | 15,432 | GO:0006955 |
| fluA12 | 15,378 | Influenza A virus | CLEC6A | 15,463 | GO:0006955 |
| fluA12 | 15,378 | Influenza A virus | CTSS | 15,481 | GO:0006955 |
| fluA12 | 15,378 | Influenza A virus | CXCL12 | 15,485 | GO:0006955 |
| fluA12 | 15,378 | Influenza A virus | CXCL12 | 15,485 | GO:0009615 |
| fluA12 | 15,378 | Influenza A virus | CXCL5 | 15,510 | GO:0006955 |
| fluA12 | 15,378 | Influenza A virus | CXCL6 | 15,500 | GO:0006955 |
| fluA12 | 15,378 | Influenza A virus | IFNGR2 | 15,451 | GO:0009615 |
| fluA12 | 15,378 | Influenza A virus | IL1RAP | 15,508 | GO:0006955 |
| fluA12 | 15,378 | Influenza A virus | MADCAM1 | 15,407 | GO:0006955 |
| fluA12 | 15,378 | Influenza A virus | MS4A1 | 15,492 | GO:0006955 |
| fluA12 | 15,378 | Influenza A virus | OAS3 | 15,457 | GO:0006955 |

TABLE 9-continued

The miRNAs and their predicted binding sites

| microRNA name | MID | Organism | Target gene name | BS SEQ ID NO | Gene Ontology ID |
|---|---|---|---|---|---|
| fluA12 | 15,378 | Influenza A virus | SMAD3 | 15,503 | GO:0050776 |
| fluA12 | 15,378 | Influenza A virus | TNFRSF11A | 15,491 | GO:0006955 |
| fluA12 | 15,378 | Influenza A virus | ZF | 15,398 | GO:0009615 | microRNA name: The miRBase registry (Release 9.2) microRNA name, excluding cases in which the names begins with "RG". In these cases the names are internal miRNA names of Rosetta Genomics.
MID: SEQ ID NO of the mature microRNA
Target gene name: Target gene name according to RefSeq database
BS SEQ ID NO: The SEQ ID NO of the binding site of the microRNA to the 3' UTR of the target gene.
Gene Ontology ID: Gene Ontology (GO) ID. All are related to viral infection and to the immune response, as described in Table 10.

TABLE 10

The description of Gene Ontology IDs

| GOid | Description |
|---|---|
| GO:0009615 | response to virus |
| GO:0051607 | defense response to virus |
| GO:0050691 | regulation of antiviral response by host |
| GO:0006959 | humoral immune response |
| GO:0006955 | immune response |
| GO:0050776 | regulation of immune response |

Description: The Gene Ontology description of GO ID

4. Synthetic Gene

A synthetic gene is also provided comprising a nucleic acid described herein operably linked to a transcriptional and/or translational regulatory sequence. The synthetic gene may be capable of modifying the expression of a target gene with a binding site for a nucleic acid described herein. Expression of the target gene may be modified in a cell, tissue or organ. The synthetic gene may be synthesized or derived from naturally-occurring genes by standard recombinant techniques. The synthetic gene may also comprise terminators at the 3'-end of the transcriptional unit of the synthetic gene sequence. The synthetic gene may also comprise a selectable marker.

5. Vector

A vector is also provided comprising a nucleic acid described herein, such as a pri-miRNA, pre-miRNA, miRNA, anti-miRNA, target gene binding site, or synthetic gene. The vector may be an expression vector. An expression vector may comprise additional elements. For example, the expression vector may have two replication systems allowing it to be maintained in two organisms, e.g., in one host cell for expression and in a second host cell (e.g., bacteria) for cloning and amplification. For integrating expression vectors, the expression vector may contain at least one sequence homologous to the host cell genome, and preferably two homologous sequences which flank the expression construct. The integrating vector may be directed to a specific locus in the host cell by selecting the appropriate homologous sequence for inclusion in the vector. The vector may also comprise a selectable marker gene to allow the selection of transformed host cells.

6. Host Cell

A host cell is also provided comprising a vector, synthetic gene or nucleic acid described herein. The cell may be a bacterial, fungal, plant, insect or animal cell. For example, the host cell line may be DG44 and DUXB11 (Chinese Hamster Ovary lines, DHFR minus), HELA (human cervical carcinoma), CVI (monkey kidney line), COS (a derivative of CVI with SV40 T antigen), R1610 (Chinese hamster fibroblast) BALBC/3T3 (mouse fibroblast), HAK (hamster kidney line), SP2/O (mouse myeloma), P3.times.63-Ag3.653 (mouse myeloma), BFA-1c1BPT (bovine endothelial cells), RAJI (human lymphocyte) and 293 (human kidney). Host cell lines may be available from commercial services, the American Tissue Culture Collection or from published literature.

7. Probes

A probe is also provided comprising a nucleic acid described herein. Probes may be used for screening and diagnostic methods, as outlined herein. The probe may be attached or immobilized to a solid substrate, such as a biochip.

The probe may have a length of from 8 to 500, 10 to 100 or 20 to 60 nucleotides. The probe may also have a length of at least 8-300 nucleotides. The probe may further comprise a linker sequence of from 10-60 nucleotides.

8. Biochip

A biochip is also provided. The biochip may comprise a solid substrate comprising an attached probe or plurality of probes described herein. The probes may be capable of hybridizing to a target sequence under stringent hybridization conditions. The probes may be attached at spatially defined addresses on the substrate. More than one probe per target sequence may be used, with either overlapping probes or probes to different sections of a particular target sequence. The probes may be capable of hybridizing to target sequences associated with a single disorder. The probes may either be synthesized first, with subsequent attachment to the biochip, or may be directly synthesized on the biochip.

The solid substrate may be a material that may be modified to contain discrete individual sites appropriate for the attachment or association of the probes and is amenable to at least one detection method. Representative examples of substrates include glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses and plastics. The substrates may allow optical detection without appreciably fluorescing.

The substrate may be planar, although other configurations of substrates may be used as well. For example, probes may be placed on the inside surface of a tube, for flow-through sample analysis to minimize sample volume. Similarly, the substrate may be flexible, such as flexible foam, including closed cell foams made of particular plastics.

The biochip and the probe may be derivatized with chemical functional groups for subsequent attachment of the two. For example, the biochip may be derivatized with a chemical functional group including, but not limited to, amino groups, carboxyl groups, oxo groups or thiol groups. Using these functional groups, the probes may be attached using functional groups on the probes either directly or indirectly using a linker. The probes may be attached to the solid support by either the 5' terminus, 3' terminus, or via an internal nucleotide.

The probe may also be attached to the solid support non-covalently. For example, biotinylated oligonucleotides can be made, which may bind to surfaces covalently coated with streptavidin, resulting in attachment. Alternatively, probes may be synthesized on the surface using techniques such as photopolymerization and photolithography.

9. miRNA Expression Analysis

A method of identifying miRNAs that are associated with disease or a pathological condition, such as viral infection is also provided, comprising contacting a biological sample with a probe or biochip provided herein and detecting the amount of hybridization. PCR may be used to amplify nucleic acids in the sample, which may provide higher sensitivity. A bioinformatic method may be used to identify a specific miRNA target or target pattern that is common among different viruses, and to identify a target of human miRNA in a viral genome. The method may be used in a system to identify a mRNA target of a host or viral miRNA. The target may be useful to evaluate the role of a miRNA in a virus-host interaction by up or down regulation, or for the development of a therapeutic use of a miRNA.

The level of the nucleic acid in the sample may also be compared to a control sample (e.g., a normal cell) to determine whether the nucleic acid is differentially expressed (e.g., overexpressed or underexpressed). The ability to identify miRNAs that are differentially expressed in pathological cells compared to a control can provide high-resolution, high-sensitivity datasets which may be used in the areas of diagnostics, prognostics, therapeutics, drug development, pharmacogenetics, biosensor development, and other related areas. An expression profile generated by the current methods may be a "fingerprint" of the state of the sample with respect to a number of miRNAs. While two states may have any particular miRNA similarly expressed, the evaluation of a number of miRNAs simultaneously allows the generation of a gene expression profile that is characteristic of the state of the cell. That is, normal tissue may be distinguished from diseased tissue. By comparing expression profiles of tissue in known different disease states, information regarding which miRNAs are associated in each of these states may be obtained. Then, diagnosis may be performed or confirmed to determine whether a tissue sample has the expression profile of normal or disease tissue. This may provide for molecular diagnosis of related conditions.

10. Determining Expression Levels

The expression level of a viral infection- or disease-associated nucleic acid may be informative in a number of ways. For example, differential expression of a viral infection- or disease-associated nucleic acid compared to a control may be diagnostic of a patient suffering from the viral infection or disease. Expression levels of a viral infection- or disease-associated nucleic acid may also be used to monitor the treatment and viral infection or disease state of a patient. Furthermore, expression levels of a viral infection- or disease-associated miRNA may allow the screening of drug candidates for altering a particular expression profile or suppressing an expression profile associated with viral infection or disease.

A target nucleic acid may be detected and levels of the target nucleic acid measured by contacting a sample comprising the target nucleic acid with a biochip comprising an attached probe sufficiently complementary to the target nucleic acid and detecting hybridization to the probe above control levels.

The target nucleic acid may also be detected by immobilizing the nucleic acid to be examined on a solid support such as nylon membranes and hybridizing a labeled probe with the sample. Similarly, the target nucleic may also be detected by immobilizing the labeled probe to a solid support and hybridizing a sample comprising a labeled target nucleic acid. Following washing to remove the non-specific hybridization, the label may be detected.

The target nucleic acid may also be detected in situ by contacting permeabilized cells or tissue samples with a labeled probe to allow hybridization with the target nucleic acid. Following washing to remove the non-specifically bound probe, the label may be detected.

These assays can be direct hybridization assays or can comprise sandwich assays, which include the use of multiple probes, as generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference.

A variety of hybridization conditions may be used, including high, moderate and low stringency conditions as outlined above. The assays may be performed under stringency conditions which allow hybridization of the probe only to the target. Stringency can be controlled by altering a step parameter that is a thermodynamic variable, including, but not limited to, temperature, formamide concentration, salt concentration, chaotropic salt concentration pH, or organic solvent concentration.

Hybridization reactions may be accomplished in a variety of ways. Components of the reaction may be added simultaneously, or sequentially, in different orders. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors and anti-microbial agents may also be used as appropriate, depending on the sample preparation methods and purity of the target.

11. Diagnostic

A method of diagnosis is also provided. The method comprises detecting a differential expression level of a disease-associated nucleic acid in a biological sample. The sample may be derived from a patient. Diagnosis of a disease state in a patient may allow for prognosis and selection of therapeutic strategy. Further, the developmental stage of cells may be classified by determining temporarily expressed disease-associated nucleic acids.

In situ hybridization of labeled probes to tissue arrays may be performed. When comparing the fingerprints between an individual and a standard, the skilled artisan can make a diagnosis, a prognosis, or a prediction based on the findings. It is further understood that the genes which indicate the diagnosis may differ from those which indicate the prognosis and molecular profiling of the condition of the cells may lead to distinctions between responsive or refractory conditions or may be predictive of outcomes.

12. Drug Screening

A method of screening therapeutics is also provided. The method comprises contacting a pathological cell capable of expressing a disease related nucleic acid with a candidate therapeutic and evaluating the effect of a drug candidate on the expression profile of the disease associated nucleic acid. Having identified the differentially expressed nucleic acid, a variety of assays may be executed. Test compounds may be screened for the ability to modulate gene expression of the disease associated nucleic acid. Modulation includes both an increase and a decrease in gene expression.

The test compound or drug candidate may be any molecule, e.g., protein, oligopeptide, small organic molecule, polysaccharide, polynucleotide, etc., to be tested for the capacity to directly or indirectly alter the disease phenotype or the expression of the disease associated nucleic acid. Drug candidates encompass numerous chemical classes, such as small organic molecules having a molecular weight of more than 100 and less than about 500, 1,000, 1,500, 2,000 or 2,500 daltons. Candidate compounds may comprise functional groups necessary for structural interaction with proteins, particularly hydrogen bonding, and typically include at least an amine, carbonyl, hydroxyl or carboxyl group, preferably at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Combinatorial libraries of potential modulators may be screened for the ability to bind to the disease associated nucleic acid or to modulate the activity thereof. The combinatorial library may be a collection of diverse chemical compounds generated by either chemical synthesis or biological synthesis by combining a number of chemical building blocks such as reagents. Preparation and screening of combinatorial chemical libraries is well known to those of skill in the art. Such combinatorial chemical libraries include, but are not limited to, peptide libraries encoded peptides, benzodiazepines, diversomers such as hydantoins, benzodiazepines and dipeptide, vinylogous polypeptides, analogous organic syntheses of small compound libraries, oligocarbamates, and/or peptidyl phosphonates, nucleic acid libraries, peptide nucleic acid libraries, antibody libraries, carbohydrate libraries, and small organic molecule libraries.

13. Gene Silencing

Also provided is a method of reducing the expression of a target gene in a cell, tissue or organ. Expression of the target gene may be reduced by expressing a nucleic acid described herein that comprises a sequence substantially complementary to one or more binding sites of the target mRNA. The nucleic acid may be a miRNA or a variant thereof. The nucleic acid may also be pri-miRNA, pre-miRNA, or a variant thereof, which may be processed to yield a miRNA. The expressed miRNA may hybridize to a substantially complementary binding site on the target mRNA, which may lead to activation of RISC-mediated gene silencing. An example for a study employing over-expression of miRNA is provided in Yekta et al 2004, Science 304-594, which is incorporated herein by reference. The nucleic acids described herein may also be used to inhibit expression of target genes using antisense methods well known in the art, as well as RNAi methods described in U.S. Pat. Nos. 6,506,559 and 6,573,099, which are incorporated by reference.

The target gene may be a viral gene, the level of which may be reduced by expressing a viral or human miRNA. The target gene may also be a human gene that is expressed upon viral infection, the level of which may be reduced by expressing a viral or human miRNA. The target of gene silencing may be a protein that causes the silencing of a second protein. By repressing expression of the target gene, expression of the second protein may be increased. Examples for efficient suppression of miRNA expression are the studies by Esau et al 2004 JBC 275-52361; and Cheng et al 2005 Nucleic Acids Res. 33-1290, which is incorporated herein by reference.

14. Gene Enhancement

Also provided is a method of increasing the expression of a target gene in a cell, tissue or organ. Expression of the target gene may be increased by expressing a nucleic acid described herein that comprises a sequence substantially complementary to a pri-miRNA, pre-miRNA, miRNA or a variant thereof. The nucleic acid may be an anti-miRNA. The anti-miRNA may hybridize with a pri-miRNA, pre-miRNA or miRNA, thereby reducing its gene repression activity. Expression of the target gene may also be increased by expressing a nucleic acid described herein that is substantially complementary to a portion of the binding site in the target gene, such that binding of the nucleic acid to the binding site may prevent miRNA binding.

The target gene may be a viral gene, expression of which may reduce infectivity of the virus. The target gene may also be a human gene, expression of which may reduce infectivity of the virus or increase resistance or immunity to the viral infection.

15. Reducing viral replication

A method of reducing the amount of viral replication is provided, which may occur via gene silencing or gene enhancement using the nucleic aid as described herein. The nucleic acid may also be used to reduce the expression of a target gene in a cell such as a viral gene in a virus-infected cell. Expression of the viral or target gene may be reduced by expressing the nucleic acid, which may comprise a sequence substantially complementary to one or more binding sites of the target gene. The nucleic acid may be a miRNA or a variant thereof. The nucleic acid may also be a pri-miRNA, pre-miRNA, or a variant thereof, which may be processed to yield a miRNA. The expressed miRNA may hybridize to a substantially complementary binding site on the target mRNA, which may lead to interruption of the function of the gene. In the case of a viral target, replication of the virus may be inhibited, and the viral infection may be reduced or eliminated.

The target gene may be a viral gene, which may be reduced by expressing a viral or human miRNA. The target gene may also be a human gene that is expressed upon viral infection, which may be reduced by expressing a viral or human miRNA. The target of gene silencing may be a protein that causes the silencing of a second protein. By repressing expression of the target gene, expression of the second protein may be decreased.

16. Therapeutic

Also provided is a method of modulating a disease or disorder, which may be associated with a viral infection. In general, the nucleic acid described herein may be used as a modulator of the expression of a gene that is at least partially complementary to the nucleic acid. Further, a miRNA molecule may act as a target for a therapeutic screening procedure, e.g. inhibition or activation of a miRNA molecule might modulate a cellular differentiation process, e.g. apoptosis.

Furthermore, an existing miRNA molecule may be used as a starting material for the manufacture of a sequence-modified miRNA molecule, in order to modify the target-specificity thereof, e.g. an oncogene, a multidrug-resistance gene or another therapeutic target gene. Further, a miRNA molecule may be modified, so that it may be processed and then generated as double-stranded siRNA that may again be directed against a therapeutically relevant target. Furthermore, a miRNA molecule may be used for tissue reprogramming procedures, e.g. a differentiated cell line might be transformed by expression of a miRNA molecule into a different cell type or a stem cell.

17. Compositions

Also provided herein is a pharmaceutical composition, which may comprise a nucleic acid described herein and optionally a pharmaceutically acceptable carrier. The nucleic acid may be an active ingredient of the composition. The composition may be used for diagnostic or therapeutic applications. The administration of the pharmaceutical composition may be carried out by known methods, wherein a nucleic acid is introduced into a desired target cell in vitro or in vivo.

The composition may be formulated in combination with appropriate, pharmaceutically acceptable carriers or diluents, and can be formulated into preparations in solid, semi-solid, liquid or gaseous forms, such as tablets, capsules, powders, granules, ointments, solutions, suppositories, injections, inhalants and aerosols. As such, administration of the agents can be achieved in various ways, including oral, buccal, rectal, parenteral, intraperitoneal, intradermal, transdermal, intracheal, etc.

18. Nucleic Acid Delivery

The nucleic acid may be introduced to a cell, tissue or organ in a single- or double-stranded form or capable of being expressed by a synthetic gene using methods well known to those skilled in the art, including as described in U.S. Pat. No. 6,506,559 which is incorporated by reference.

Methods for the delivery of nucleic acid molecules are described in Akhtar et al., (Trends Cell Bio. 2, 139, 1992). WO 94/02595 describes general methods for delivery of RNA molecules. These protocols can be utilized for the delivery of virtually any nucleic acid molecule. Nucleic acid molecules can be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. Alternatively, the nucleic acid/vehicle combination is locally delivered by direct injection or by use of an infusion pump. Other routes of delivery include, but are not limited to oral (tablet or pill form) and/or intrathecal delivery (Gold, 1997, Neuroscience, 76, 1153-1158). Other approaches include the use of various transport and carrier systems, for example, through the use of conjugates and biodegradable polymers. More detailed descriptions of nucleic acid delivery and administration are provided for example in WO93/23569, WO99/05094, and WO99/04819.

The nucleic acids can be introduced into tissues or host cells by any number of routes, including viral infection, microinjection, or fusion of vesicles. Jet injection may also be used for intra-muscular administration, as described by Furth et al. (Anal Biochem 115 205:365-368, 1992). The nucleic acids can be coated onto gold microparticles, and delivered intradermally by a particle bombardment device, or "gene gun" as described in the literature (see, for example, Tang et al. Nature 356:152-154, 1992), where gold microprojectiles are coated with the DNA, then bombarded into skin cells.

19. Kits

Also provided is a kit comprising a nucleic acid described herein together with any or all of the following: assay reagents, buffers, probes and/or primers, and sterile saline or another pharmaceutically acceptable emulsion and suspension base. In addition, the kit may include instructional materials containing directions (e.g., protocols) for the practice of the methods described herein.

20. Virus

The methods and nucleic acids described herein may be associated with any one of a number of different visuses, including HSV1, HSV2, RSV, EBV, Influenza A, HCV, HPV, HIV, HBV, and Vaccinia. Influenza virus infection is a major public health problem, causing millions of cases of severe illness and as many as 500,000 deaths each year worldwide (WHO report, 2004, A56/23). Influenza virus has A, B and C types, among which the type A can be further classified into many sub-types according to the variations in NA and HA genes. Thus far, there have been 15 HA subtypes and 9 NA subtypes and the different combinations between HA and NA subtypes can form many types of influenza A virus subtypes.

Although inactivated vaccines are 60-80% effective against the matched influenza strains, vaccination coverage is a problem worldwide. Moreover, this strategy provides no protection against unexpected strains. Currently, antiviral drugs are the best defense against these outbreaks, but they provide only partial protection (Nicholson, etc., Lancet, 355: 1845-1850, 2000), usually companied with some side effects, especially to the central nervous system (Wenzel, JAMA, 283:1057-1059, 2000).

Epstein Barr Virus (EBV), a large DNA virus of the Herpes family that infects normal human B cells, is the etiologic agent of infectious mononucleosis and is strongly associated with Burkitt's lymphoma and nasopharingal carcinoma.

Herpes simplex virus type-1 and 2 (HSV1 and HSV2) enter and reactivate from latency in sensory neurons, although the events governing these processes are little understood. During latency, only the latency-associated transcripts are produced.

21. Disease

The methods and nucleic acids described herein may be associated with any one of a number of different diseases, including Burkitt's lymphoma, nasopharingal carcinoma, ovarian carcinoma, cervical cancer, hepatitis, mononucleosis, influenza, genital herpes, encephalitis, and bronchiolitis.

EXAMPLES

Example 1

Prediction of MiRNAs

We surveyed a number of viral genomes for potential miRNA coding genes using three computational approaches similar to those described in U.S. Patent Application No. 60/522,459, Ser. Nos. 10/709,577 and 10/709,572, the contents of which are incorporated herein by reference, for predicting miRNAs. The predicted hairpins and potential miRNAs were scored by thermodynamic stability, as well as structural and contextual features. The algorithm was calibrated by using miRNAs in the Sanger Database which had been validated.

1. Viral Genome Screen

Table 1 and Table 8 list the SEQ ID NO for each predicted hairpin ("HID") of a particular viral genome ("V"; See also Table 7). Table 1 also lists the genomic location for each hairpin ("Hairpin_Loc"). The format for the genomic location is a concatenation of <strand><start position>. For viruses that have more than one chromosome or segment, such as Influenza A, the segment number is identified in column "C" (viruses with only one chromosome have a value of 1 in this column). The genetic location is based on the NCBI—Entrez Nucleotides database. The Entrez Nucleotides database is a collection of sequences from several sources, including GenBank, RefSeq, and PDB. Table 7 shows the accession number and the build (version) for each of the viral genomes used in this screen. Two viruses in Table 7 have multiple accession numbers because each segment (i.e., chromosome analog) of the virus' genomes had a different accession number. One of the viruses has no accession number.

Table 1 also lists the SEQ ID NO ("MID") for each predicted miRNA and miRNA*. Table 1 also lists the prediction score grade for each hairpin ("P") on a scale of 0-1 (1 means that the hairpin is the most reliable), as described in Hofacker et al., Monatshefte f. Chemie 125: 167-188, 1994. Table 1 also lists the p-value ("Pval") calculated out of background hairpins for the values of each P scores. All the p-values were significant, i.e., less than 0.05. If the Pval is indicated as 0.0, then the Pval is less than 0.0001. The p-values were calculated by comparing the palgrade of the tested hairpin to the palgrade of other sequences without pre-selection of hairpins.

Table 1 also lists whether the miRNAs were validated by expression analysis ("E") (Y=Yes, N=No), as detailed in Table 2. It should be noted that failure to sequence or detect expression of a miRNA does not necessarily mean that a miRNA does not exist. Such undetected miRNAs may be expressed in tissues other than those tested. In addition, such undetected miRNAs may be expressed in the test tissues, but at a difference stage or under different conditions compared to the experimental cells.

Table 1 also lists a genetic location cluster ("LC") for those hairpins that are within 1,000 nucleotides of each other of a particular virus. Each miRNA that has the same LC shares the same genetic cluster. Hairpins that overlap were not clustered.

Example 2

Prediction of Target Genes

The predicted miRNAs from the computational screen of Example 1 were used to predict human and viral target genes and their binding sites using computational approaches for predicting miRNAs, similar to approaches described in U.S. Patent Application No. 60/522,459, Ser. Nos. 10/709,577 and 10/709,572, the contents of which are incorporated herein by reference.

1. Human Genome Screen
   a. Human Target Genes

Table 3 and Table 9 list a predicted human target gene for each miRNA ("MID") from a particular virus ("V") and its hairpin ("HID") from the viral genome screen. The virus codes listed in "V" are, as for Table 1, defined in Table 7. The names of the target genes ("Target_Gene") in Table 3 were taken from NCBI Reference Sequence release 9 (http://www.ncbi.nlm.nih.gov; Pruitt et al., Nucleic Acids Res, 33(1): D501-D504, 2005; Pruitt et al., Trends Genet., 16(1):44-47, 2000; and Tatusova et al., Bioinformatics, 15(7-8):536-43, 1999). Target genes were identified by having a mammalian conserved perfect complementary match of a 7 nucleotide miRNA seed (positions 2-8) and an A on the UTR (total=8 nucleotides). For a discussion on identifying target genes, see Lewis et al., Cell, 120: 15-20, (2005). For a discussion of the seed being sufficient for binding of a miRNA to a UTR, see Lim Lau et al., (Nature 2005) and Brenneck et al, (PLoS Biol 2005).

The binding site screen only considered the first 4000 nucleotides per UTR and considered the longest transcript when there were several transcripts per gene. The filtering reduced the total number of transcripts from 23626 to 14239. Table 3 lists the SEQ ID NO for the predicted binding sites ("Binding_site") for each target gene. The sequence of the binding site includes the 20 nucleotides 5' and 3' of the binding site as they are located on the spliced mRNA. In cases that the binding site is comprised from 2 exons, 20 nucleotides are included from both 5' and 3' ends of both exons.

b. Viral Target Genes

Human Herpes virus 1 and 2 are related to any of several inflammatory diseases caused by a herpesvirus and marked in one case by groups of watery blisters on the skin or mucous membranes (as of the mouth and lips) above the waist and in the other by such blisters on the genitals. Human herpesvirus 4 (Epstein-Barr virus) is capable of causing infectious mononucleosis and is associated with Burkitt's lymphoma and nasopharyngeal carcinoma. HIV strains are related to Acquired Immune Deficiency Syndrome (AIDS). Hepatitis B and C viruses are capable of causing inflammation of the liver. Human papillomavirus is capable of causing cervical cancer, human respiratory syncytial virus (RSV) is capable of causing respiratory disease, and Influenza A virus is capable of causing Influenza. Vaccinia virus has not been shown to be capable of causing disease in humans, and is usually used for the preparation of vaccines.

Example 3

Validation of miRNAs

To confirm the hairpins and miRNAs predicted in Example 1, we detected expression in various tissues using the high-throughput microarrays similar to those described in U.S. Patent Application No. 60/522,459, Ser. Nos. 10/709,577 and 10/709,572, the contents of which are incorporated herein by reference. For each predicted precursor miRNA, mature miRNAs derived from both stems of the hairpin were tested.

1. Expression Analysis

Table 2 shows the hairpins ("HID") of the third prediction set that were validated by detecting expression of related miRNAs ("MID") from a particular virus ("V"), as well as a code for the tissue ("Tissue") in which expression was detected. In cases where there was more than one score from the same miRNA in the same tissue, only the miRNA with the higher score is presented.

The tissue and disease codes are listed in Table 4 and Table 5, respectively. Table 6 shows the relationship between each gene and at least one disease, enabling a miRNA described herein to be connected to a disease. Table 6 condenses data derived from OMIM and lists for each gene the numeric code(s) of the disease(s) associated with the gene.

All the tissues disclosed give an indication of a viral disease. The fact that significant expression of the virus was measured implies that in this tissue it may be involve in a viral disease(s). For example, if a miRNA from HIV is expressed in a T cell line it may have an effect on AIDS. Of course cell lines represent only subset of the features of a tissue as its function in an organ however we can deduce from the expression as it is measured in the cell line.

Table 2 also shows the chip expression score grade, which ranges from 500 to 65000 ("S"). A threshold of 500 was used to eliminate non-significant signals and the score was normalized by miRNA microarray probe signals from different experiments. Variations in the intensities of fluorescence material between experiments may be due to variability in RNA preparation or labeling efficiency. Normalization was performed based on the assumption that the total amount of miRNAs in each sample was relatively constant. First, the background signal was subtracted from the raw signal of each probe, where the background signal was defined as 400. Next, each miRNA probe signal was divided by the average signal of all miRNAs, multiplied by 10000 and added back the background signal of 400. Thus, by definition, the sum of all miRNA probe signals in each experiment was 10400.

Table 2 also shows a statistical analysis of the normalized signal ("Spval") calculated on the normalized score. For each miRNA, a relevant control group was used out of the full predicted miRNA list. Each miRNA had an internal control of probes with mismatches. The relevant control group contained probes with similar C and G percentage (abs diff<5%) in order to have a similar Tm. The probe signal P value is the ratio over the relevant control group probes with the same or higher signals. The results were p-value ≦0.05 and the score was above 500. In those cases for which the SPVal is listed as 0.0, the value is less than 0.0001.

2. Sequencing

To further validate the hairpins ("HID") of the second prediction, a number of miRNAs were validated by sequencing methods similar to those described in U.S. Patent Application No. 60/522,459, Ser. Nos. 10/709,577 and 10/709,572, the contents of which are incorporated herein by reference.

3. Northern Blot Analysis

Figure 6:
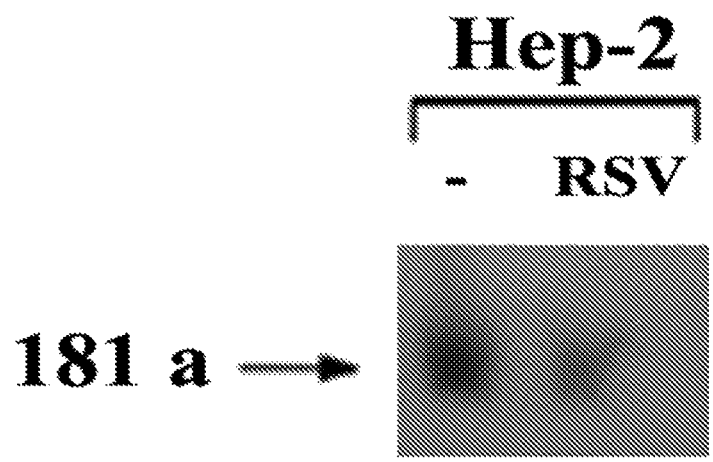
FIG. 6 shows Northern blot analysis of hsa-miR-181a (SEQ ID NO: 15,366) differentially expressed in HEp2 uninfected (−) and RSV infected cells.
Figure 9:
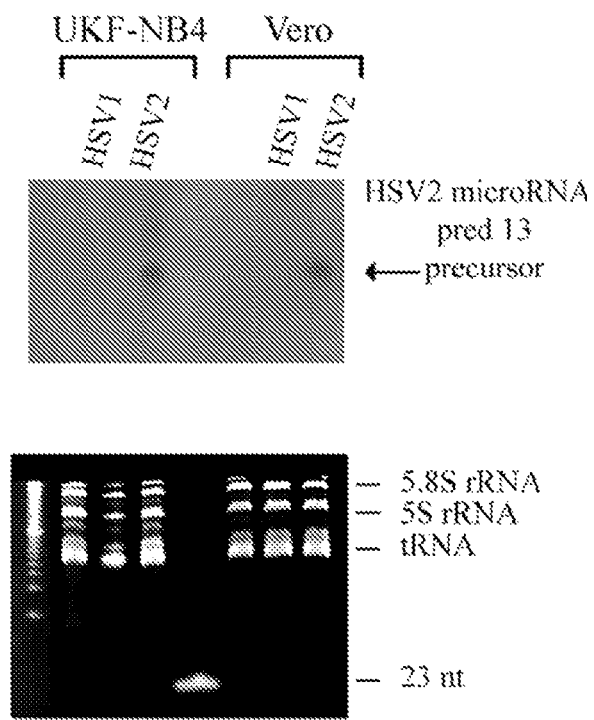
FIG. 9 shows Northern blot analysis of HSV2 microRNA-pred-13 (SEQ ID NO: 15,376). The lower part of the figure depicts Ethidium Bromide staining of the gel.
Figure 10:
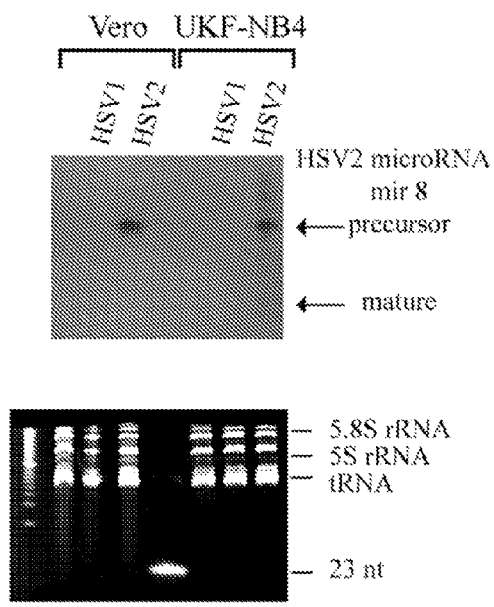
FIG. 10 shows Northern blot analysis of HSV2 microRNA-8 (SEQ ID NO: 15,377). The lower part of the figure depicts Ethidium Bromide staining of the gel.

A group of miRNAs were validated by Northern blot analysis, as shown in FIGS. 6, 9 and 10.

Example 4

Preparation of RNA Libraries from Virus-infected Cells and from Interferon α Treated Cells RNA libraries from virus-infected cells were prepared. For each library from infected cells, a control library from uninfected cells was also prepared. Total RNA was extracted from the paired cell lines (infected and uninfected) and labeled directly with either Cy5 or Cy3 (mirVana™ miRNA Labeling Kit, Ambion). Each set (labeled with either Cy3 or Cy5) was tested on the same micro-array slide of microRNAs (MIRDICATOR™, Rosetta Genomics).

RNA libraries were prepared from the following cell lines and viruses:
 a. Primary human fibroblasts (HF, from amnion synthesis), human neuroblastoma cell line (UKF NB4), and Vero cells, infected with HSV1 or HSV2, including libraries of early stage and late stage of infection for both viruses.
 b. HEp2 cells infected with Respiratory Syncytial Virus (RSV).
 c. MDCK cells (dog cells) infected with Influenza A (FluA).

In each case a library was also prepared from an uninfected control of the same cell line.

RNA libraries were also prepared from interferon α treated cells and from untreated cells to evaluate the effect of interferon α on microRNA production.

MIRDICATOR™ microRNA array were used to detect novel host and viral encoded miRNAs in the libraries (phase-1).

Glass slides were printed with probes of all the known hsa-mirs in anti-sense (AS) orientation; as well as various positive and negative controls (e.g. U6). In addition, AS probes to the predictions of microRNAs of viral genes were included. The predicted viral-microRNAs that were probed and analyzed were: HSV1, HSV2, RSV, and FluA microRNAs. Therefore, for single hybridization, two sets of positive signals on the microRNA array were obtained: expression of host (human) microRNAs and expression of viral microRNAs, in infected versus uninfected cells.

Example 5

Use of MIRDICATOR™ MicroRNA Array to Detect RSV Induced miRNAs

Total RNA was extracted from HEp2 cells infected with RSV or from control non-infected HEp2 cells and labeled with cy3 and cy5. The probes were hybridized together to the same microRNA array slide. The results depict signals for all microRNAs for both probes plotted against each other.

FIG. 1 shows the results of RSV infected and uninfected HEp2 cells hybridized on microRNA array. The human microRNA RG_AMB_10594 (SEQ ID NO: 15,374) was significantly upregulated in the RSV infected HEp2 cells as compared to uninfected control cells. The results suggest that host microRNAs may play a role in RSV replication.

Example 6

Use of MIRDICATOR™ to Detect FluA Encoded MicroRNAs

MDCK cells were infected with FluA and control cells were left uninfected. Three days after infection RNA was extracted, labeled with Cy3 and Cy5 and hybridized to the glass-microRNA array.

Figure 2A:
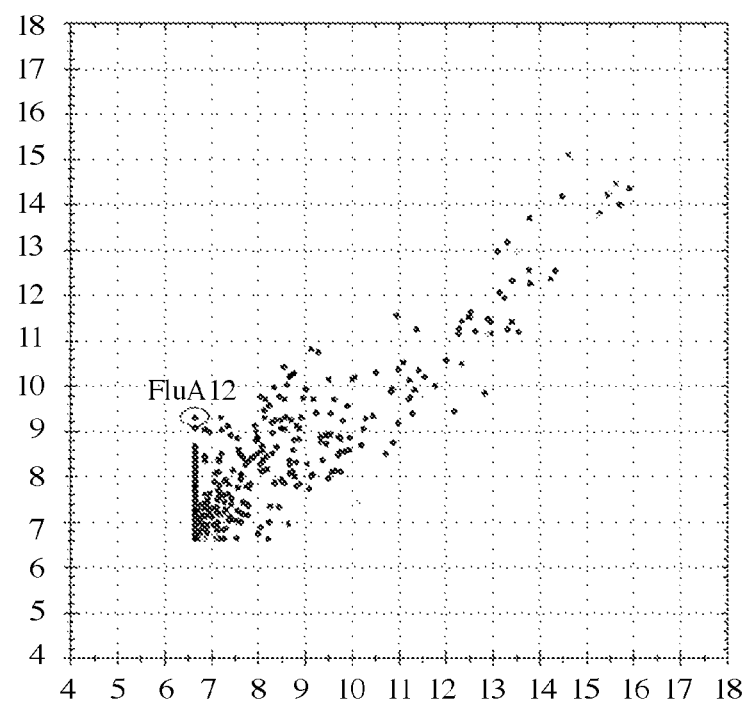
FIGS. 2A-2B show microRNA expression profiling of MDCK cells infected with Influenza A (FluA) as compared to uninfected control cells using miRdicator™ microRNA array. The expressed microRNA of FluA-12 (SEQ ID NO: 15,378) is circled. Two independent experiments are shown.
Figure 2B:
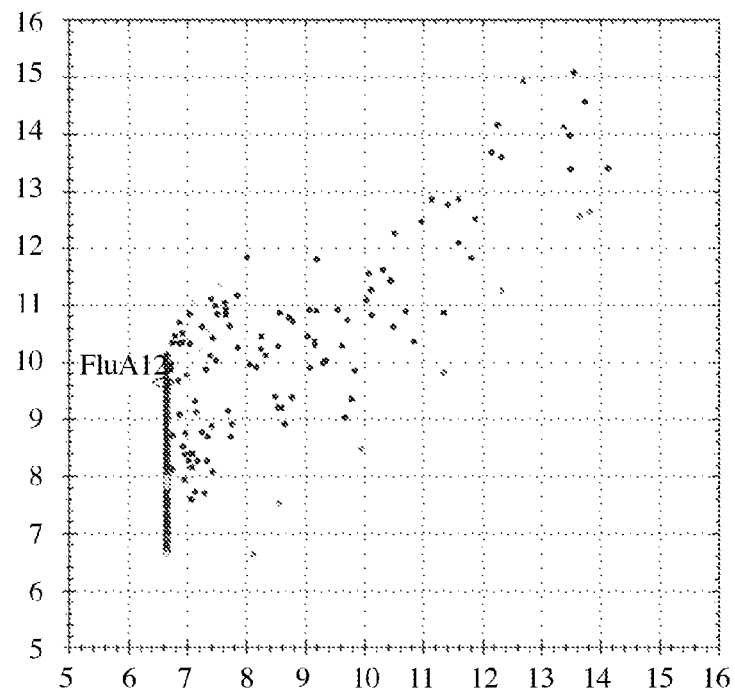

The results shown in FIGS. 2A-2B as a plot of MDCK cells infected with FluA vs. uninfected cells. Two independent experiments are shown. Out of 12 FluA probes (predicted by the bioinformatics-algorithm and spotted on the microRNA array), one, FluA-12 (SEQ ID NO: 15,378), gave a positive signal as shown circled in FIGS. 2A-2B. This viral-microRNA is validated by real time PCR for microRNAs (MIR-PCR, see details of the procedure below).

Example 7

Use of MIRDICATOR™ to detect HSV-1 & HSV-2 Encoded MicroRNAs

Neuroblastoma, Vero cells (cell line from green monkey's kidney) and human fibroblasts (HF) were infected with either HSV-1 or HSV-2. RNAs were extracted and labeled with cy3 and cy5. Eighteen samples from Vero cells and human fibroblasts (HF) were hybridized together to the same type of microRNA array slide. Each set of samples were either uninfected or infected with HSV-1 or with HSV-2. The results depict signals for all microRNAs from both probes, plotted against each other.

Figure 3:
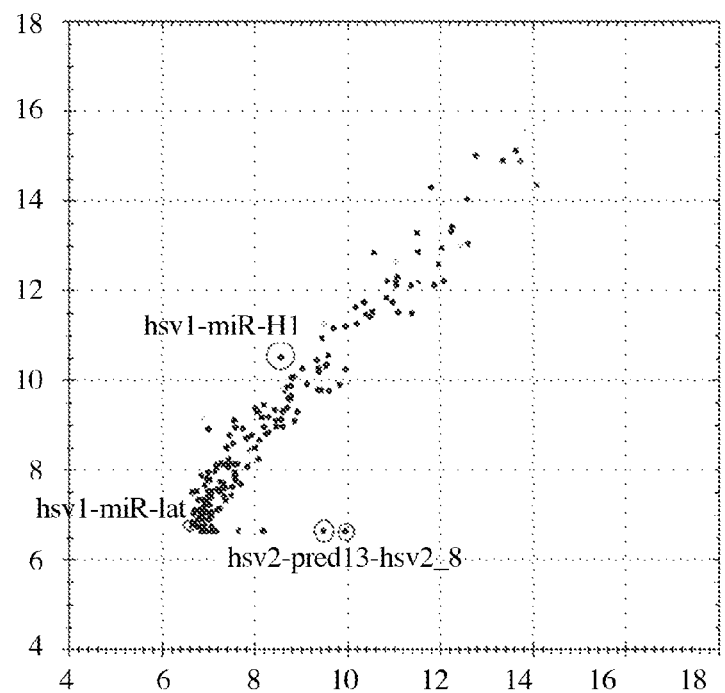
FIG. 3 shows microRNA expression profiling of herpes simplex virus type 1 (HSV1) microRNAs in Vero cells infected with HSV1 and HSV2 as compared to uninfected control cells. The expressed microRNA HSV1-miR-H1 (SEQ ID NO: 15,375) is indicated.

As shown in FIG. 3, the expression of hsvl-miR-H1 (SEQ ID NO: 15,375) was found in the late stage of HSV-1 infected Vero cells.

Figure 4:
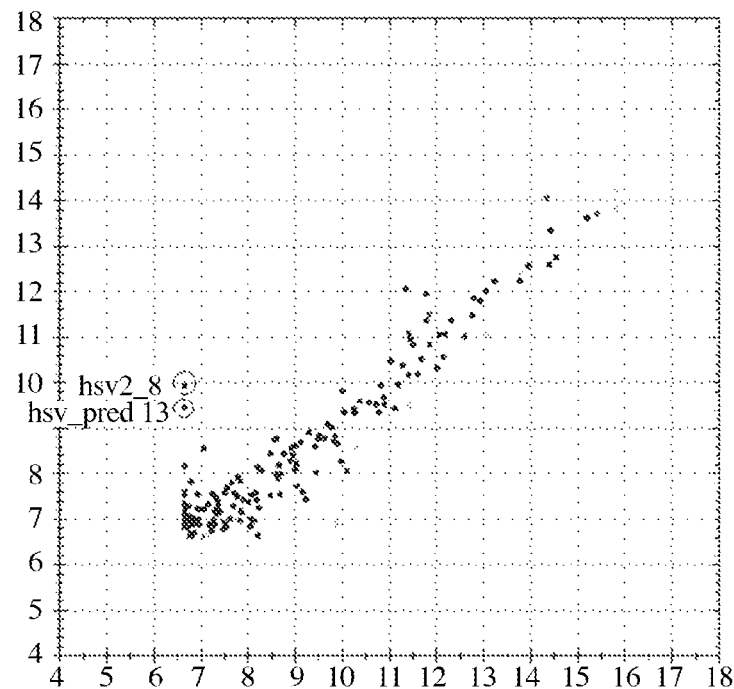
FIG. 4 shows microRNA expression profiling of HSV2 microRNAs in Vero cells infected with HSV2. The expressed microRNAs: HSV2-Pred13 (SEQ ID NO: 15,376) and HSV2-8 (SEQ ID NO: 15,377) are indicated.

Two novel microRNAs of HSV-2: hsv2-8 (SEQ ID NO: 15,377) and hsv2-pred13 (SEQ ID NO: 15,376) were found to be expressed in HSV2-infected Vero cells as shown in FIG. 4, and to a lesser extent in human neuroblastoma cell (UKF-NB4). These microRNAs are originated from the 3' arm and the 5' arm of the same pre-microRNA and are found twice in the HSV-2 genome. The HSV-2 microRNAs were found to be expressed at the late stage of infection. These are the first validated two microRNAs of HSV-2, a main cause of genital herpes. The data was confirmed further by MIR-PCR (FIG. 7) and by Northern blot analyses (FIGS. 9-10).

Example 8

Use of MicroRNA Array miRdicator™ to Detect Host MicroRNA Differential Expression During Viral Infections Up and down regulation of host microRNA (Homo sapiens, hsa-mirs) during viral infections could be observed in several infected cell lines. MDCK cells were infected with FluA. An uninfected control was included. Three days after infection RNA was extracted, labeled with Cy3 and Cy5 and hybridized to the glass-microRNA array.

Table 11 depicts differential expression of host microRNAs that are common to Homo sapiens and MDCK in FluA infected cells. The results are average of two experiments. These results are further validated by miRNA-RT-PCR and Northern blots.

Host hsa-miR-181a expression (SEQ ID NO: 15,366), is reduced not only in FluA infected MDCK cells, but also in RSV infected HEp2 cells (see Northern blot analysis in FIG. 6). The results of the microRNA array for hsa-miR-296 (SEQ ID NO: 15,370), hsa-miR-210 (SEQ ID NO: 15,372), hsa-miR-193a (SEQ ID NO: 15,367), hsa-miR-181a, hsa-miR-107 (SEQ ID NO: 15,368) and hsa-miR-103 (SEQ ID NO: 15,369) by Northern blot and miR-PCR analysis are under validation.

TABLE 11

Differential expression of host miRs in MDCK cells infected with FluA

| probe source | Signal from infected cells | Signal from un-infected cells | Fold change | comments |
|---|---|---|---|---|
| hsa_miR_296 | 2674.5 | 435.5 | (+)6 | up-regulated in infected cells |
| hsa_miR_210 | 461 | 1746 | (−)3.8 | down-regulated in infected cells |
| hsa_miR_193a | 2116.5 | 11879 | (−)5.6 | down-regulated in infected cells |
| hsa_miR_181a | 1880.5 | 10124 | (−)5.4 | down-regulated in infected cells |
| hsa_miR_107 | 1160 | 6898 | (−)5.9 | down-regulated in infected cells |
| hsa_miR_103 | 661 | 4243 | (−)6.4 | down-regulated in infected cells |

Example 9

Higher Expression of Human hsa-miR-21 in Vero Cells Infected with HSV1 in Comparison to Vero Cells Infected with HSV2

Figure 8:
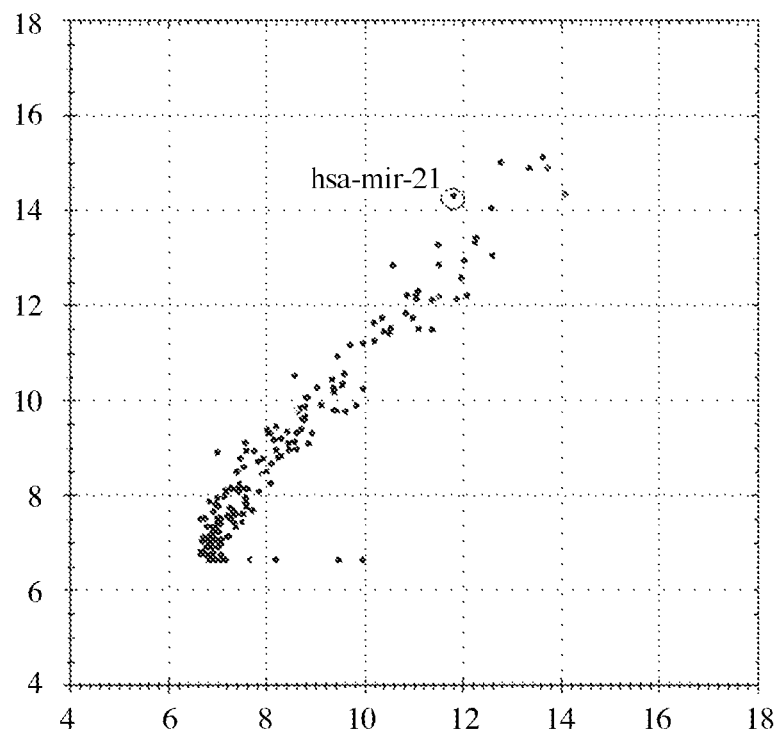
FIG. 8 shows higher expression of hsa-mir-21 (SEQ ID NO: 15,373) in Vero cells infected with HSV1 in comparison with HSV2 infected cells.

Following infection of Vero cells with HSV-1 and HSV-2, RNA was extracted, labeled with Cy3 and Cy5 and hybridized to the glass-microRNA array. As demonstrated in FIG. 8, hsa-miR-21 (SEQ ID NO: 15,373) is expressed at higher levels in Vero cells infected with HSV-1 in comparison to Vero cells infected with HSV2.

Example 10

Figure 5A:
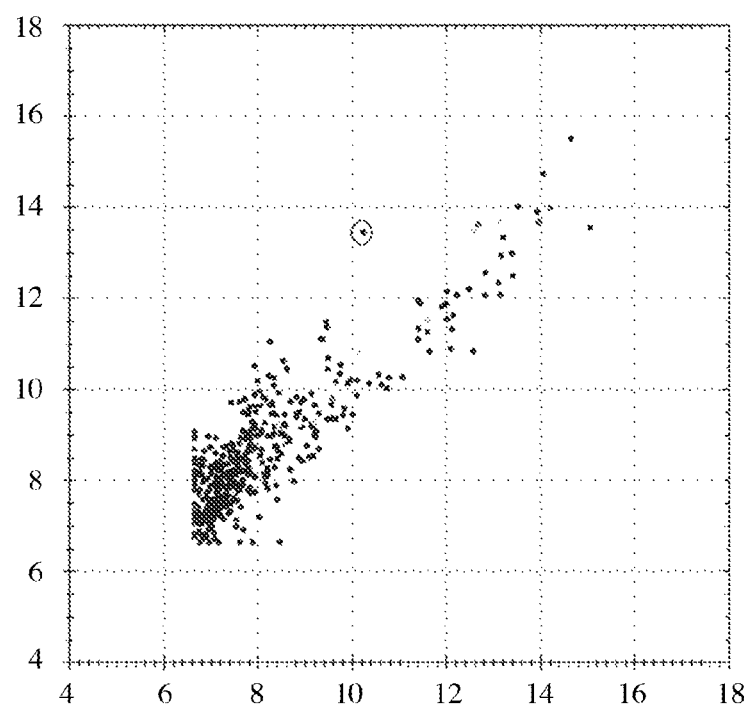
FIGS. 5A-5B show up-regulation of host microRNA AMB-10594 (SEQ ID NO: 15,374) (circled) following various viral infections of various cells: RSV infected HEp2 cells (FIG. 5A), HSV2 infected HF cells (FIG. 5B), HSV1 infected HF cells (FIG. 5D), and following interferon treatment of HF cells (FIG. 5C).
Figure 5B:
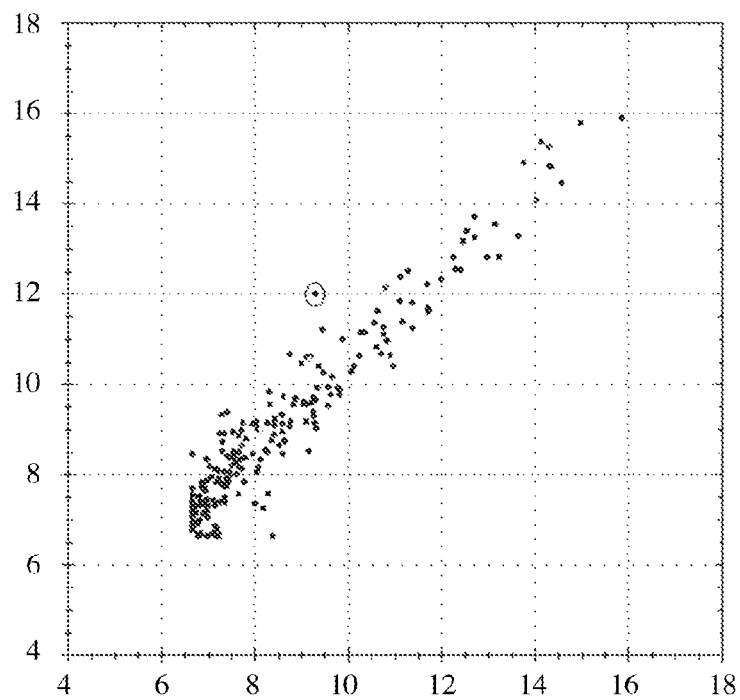
Figure 5C:
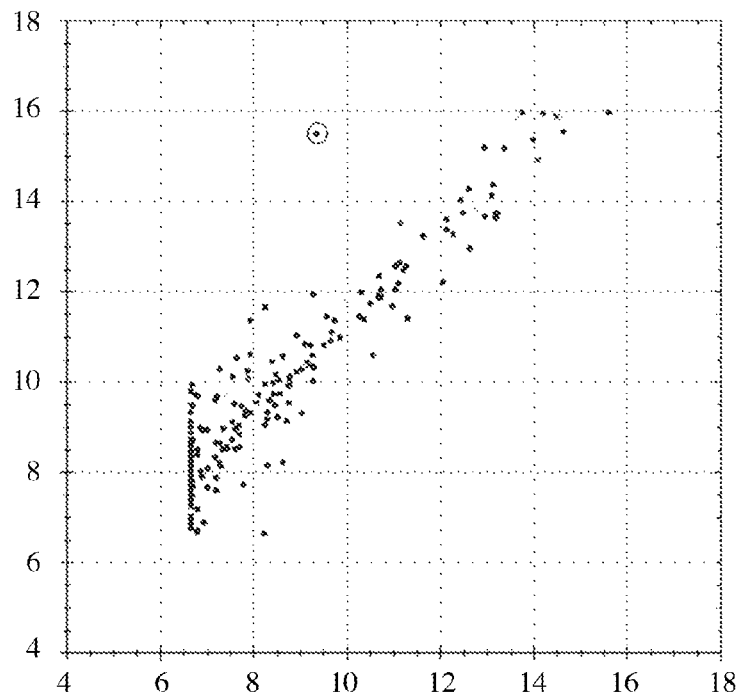
Figure 5D:
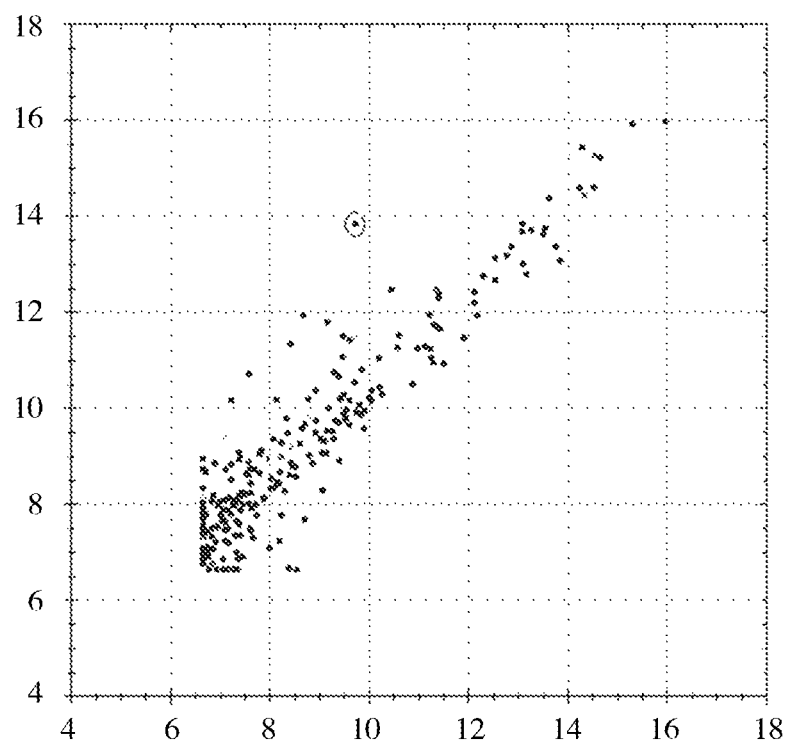

Expression of Host miRNA AMB-10594 in Viral Infected or Interferon Treated Cells The following tests were carried out: interferon α treated human fibroblasts (HF), HSV-1 and HSV-2 infected HF cells, and RSV infected Hep2 cells. All tests included an untreated or uninfected control. Three days after interferon α treatment or viral infection RNA was extracted, labeled with Cy3 and Cy5 and hybridized to the glass-microRNA array. As shown in FIG. 5, increased expression of host-miR AMB-10594 (SEQ ID NO: 15,374) (shown circled) was found in: interferon treated HF cells (FIG. 5C), HSV1 infected HF cells (FIG. 5D), HSV2 infected HF cells (FIG. 5B), and RSV infected HEp2 cells (FIG. 5A). In each of the graphs the treated/infected cells are plotted against the untreated/uninfected cells.

Example 11

Validation of the Results of the Microarray Screening by Northern Blot Analysis and by Cloning of miRNAs from Libraries of Virus Infected and Cytokines Treated Cells The results obtained from the microarray analysis were validated in two procedures:

I. Northern blot analysis. Northern blot analysis comparing RSV infected HEp2 cells with uninfected HEp2 cells was performed. 50 ug of RNA/slot were subjected to acrylamide-gel electrophoresis. Northern blot analysis was performed using a $P^{32}$-labeled-AS-probe to human hsa-miR-181a. The result shown in FIG. 6 indicates the down-regulation of the host miR in the RSV infected cells, thus confirming the microarray results.

II. Real time PCR, aimed at amplification of miRs (miR-PCR), adopted from Shi and Chiang, (Biotechniques, 2005. 39(4): p. 519-25). As little as 100 pg total RNA is polyadenylated and reverse-transcribed with a poly(T) adapter into cDNAs for real-time PCR using the miR-specific forward primer and the sequence complementary to the poly(T) adapter as the reverse primer. This real-time PCR method is simple and sensitive for quantifying the expression of miRs and also reveals miR tissue-specific expression patterns that cannot be resolved by Northern blot analysis.

Figure 7A:
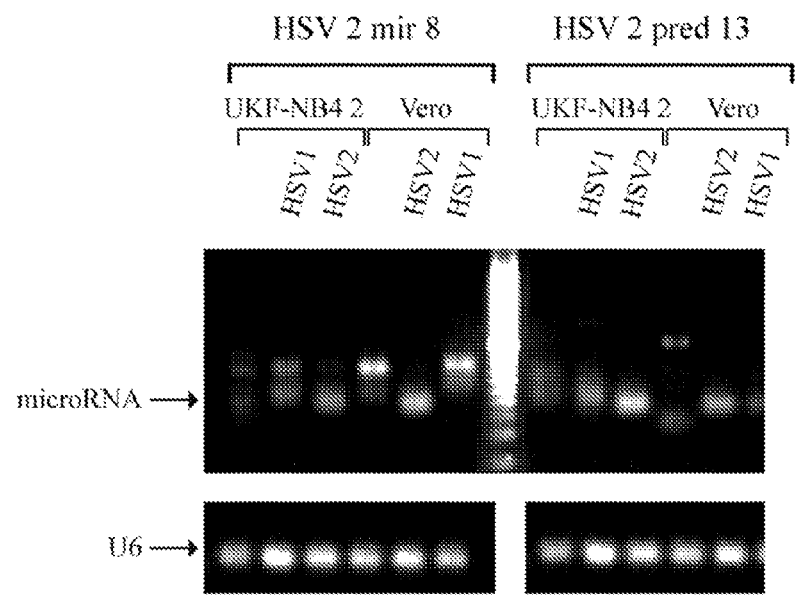
FIGS. 7A-7B show real time PCR analysis of HSV2 microRNA-pred-13 (SEQ ID NO: 15,376), HSV2 microRNA-8 (SEQ ID NO: 15,377) and their bulge.
Figure 7B:
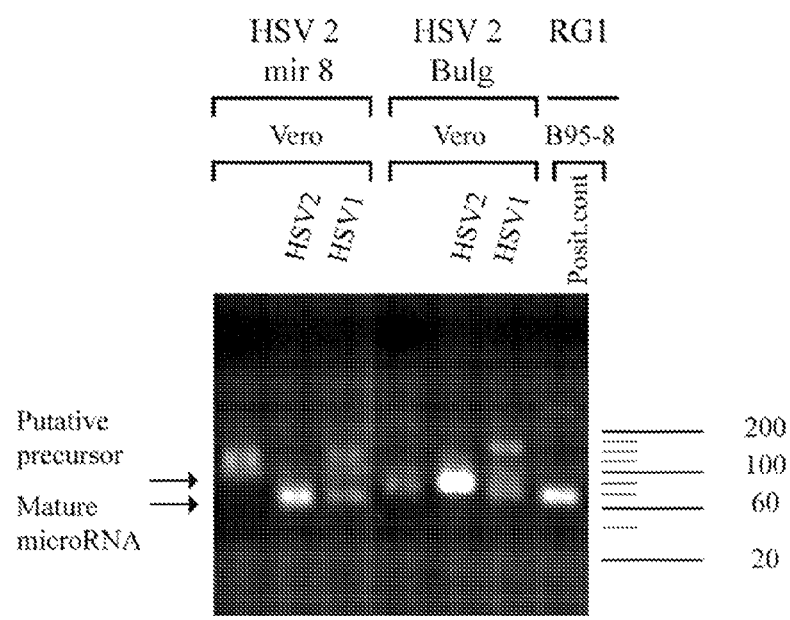

Analysis by miR-PCR demonstrated specific expression of the two novel HSV2 miRs (HSV2-miR-8 (SEQ ID NO: 15,377) and HSV2-mir-pred13 (SEQ ID NO: 15,376) in HSV2 infected neuroblastoma (UKF-NB4) and Vero cells. Total RNA was extracted from infected cells, polyadenylated and reverse-transcribed with a poly(T) adapter into cDNAs. The results are shown in FIG. 7: miR-specific forward primer HSV2-miR-8 (FIGS. 7A and 7B), HSV2-miR-pred13 (FIG. 7A) or bulge-primer (FIG. 7B). The reverse primer used was the sequence complementary to the poly(T) adapter. The products were subjected to agarose gel electrophoresis to determine their relative size. Nonspecific bands formed the same pattern in uninfected and HSV1 infected cells.

The results of the miR-PCR revealed a bulge probe (as expected), a higher band of about 100 nucleotides corresponding to the pre-microRNA precursor of these miRs (FIG. 7).

For Northern blot analysis, total RNA was extracted from either Vero cells or human neuroblastoma cells (UKF-NB4): uninfected, and HSV-1 and HSV-2 infected. The samples were enriched for small RNAs (Ambion kit). The small RNAs samples were run on Urea gel, 10 μg/lane, blotted to Nitrocellulose and hybridized with $^{32}P$ labeled probe to HSV2-mir-pred-13 or with $^{32}P$ labeled probe to HSV2-mir-8 (SEQ ID NO: 15,377). As shown in FIG. 9, after exposure of 30 days the precursor (~100 nts) of HSV2-mir-pred-13 (15,376) was visible. As shown in FIG. 10, the precursor of HSV2-mir-8 (~100nts) was visible and in UKF-NB4, a band at the region of ~22nts was also detected. The hybridization was specific to HSV2; no signal was detected under the same conditions with either uninfected cells or cell infected with HSV1. Experiments with specific inhibitors to these HSV2 miRs will help to determine their role in HSV-2 infection.

Example 12

Epstain Barr-Virus (EBV) MicroRNAs are Differentially Expressed and can Block the Viral Replication The EBV virus encodes several distinct miRNAs in latently infected cells that are located in two main clusters. The BART miRNAs (SEQ ID NOs: 15,516, 15,520, 15,522, 15,524 and 15,526) are expressed at high levels in stages I and II of latency, whereas the BHRF1 miRNAs (e.g. SEQ ID NO: 15,518) are expressed at high levels in stage III latency, while being essentially undetectable in other stages of virus life cycle. Induction of lytic EBV replication in B95-8 cells, by Cisplatin and 12-O-tetradecanonoyl phorbol-13-acetate (TPA) with n-Butyric acid or by TET ON/OFF regulated expression of immediate early (IE) gene ZEBRA (BZLF1), resulted in high expression of one of the BHRF-1-microRNA-cluster. This cluster is localized on the 5' and 3'-UTRs of BHRF1 mRNA. ZEBRA, is IE key gene in EBV switch to lytic infection. EBV replication resulted in LMP-1 (latency associated protein 1) reduction and increased viral load as determined by FACS and RT-PCR.

B95-8 cells persistently infected with EBV were transfected with various antagonists (2-O-Methyl antimir oligonucleotides, SEQ ID NOs: 15,517, 15,519, 15,521, 15,523, 15,525, and 15,527) to EBV microRNAs. After 120 hrs, cells were harvested, DNA was extracted, and EBV DNA copies/ml was determined by qRTPCR, using commercial standards for EBV viral load (FIG. 11).

BHRF-1, a viral homologue to Bc12 oncogene, is also a member of the IE proteins of EBV. Antisense blockage of BHRF1-miRNA expression resulted in increased number of viral particles, up to ten fold, in comparison to GFP control nonspecific antisense treatment (FIG. 11).

Figure 11:
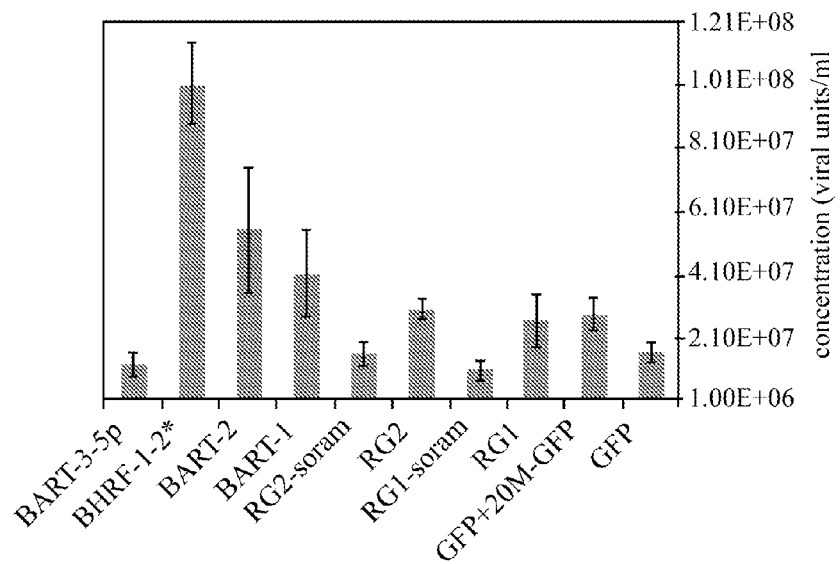
FIG. 11 shows the results of quantitative RT-PCR of EBV viral load in B95-8 cells transfected with EBV anti-mir oligonucleotides. B95-8 cells persistently infected with EBV were transfected with various antagonists (2-O-Methyl anti-mir oligonucleotides, SEQ ID NOs: 15,517, 15,519, 15,521, 15,523, 15,525, and 15,527) to EBV microRNAs. After 120 hrs, cells were harvested, DNA was extracted, and EBV DNA copies/ml was determined by qRTPCR, using commercial standards for EBV viral load.

Anti-microRNA to BART-2 had a moderate effect on viral replication (FIG. 11). Taken together, the result supports the notion that microRNAs play a central role in the control of viral life cycle and that their suppression leads to lytic activation and escape from latency. These findings also indicate the potential use of microRNAs as bases for antiviral therapies.

Over expression of BHRF1-miRNA is achieved by transfection of oligonucleotide mimicking the BHRF-1 microRNA into B-95-8 cells, using serial dilutions. The oligonucleotides are comprised of two small synthetic RNA molecules with 5'-phophorylation (5'-/phos/rUrArUrCrUrU-rUrUrGrCrGrGrCrArGrArArArUrUrGrA-3' (SEQ ID NO: 4,581); and 5'-/phos/rArArArUrUrCrUrGrUrUrGrCrAr-GrCrArGrArUrArGrC) (SEQ ID NO: 15,518), hybridized to each other Immediately after transfection and at 24 hrs intervals the transfected cells are harvested and EBV viral load is tested by RT-PCR.

Differential expression of EBV-mir-BHRF 1-2* (SEQ ID NO: 15,518) is tested in B-95-8, before and after induction with doxycycline treatment which initiates viral early cycles. RNA is extracted from the treated and untreated cells for Northern blot analysis.

Example 13

Testing the Effect of HSV2 MicroRNAs on HSV2 Replication

Neuroblastoma and Vero cells that are stably transfected with a plasmid containing the preMicrRNA of HSV2 (the precursor of HSV2-mir 8 and HSV2-mir-pred13, SEQ ID NOs: 15,389 and 15,392), cloned under IE-CMV-promoter in pEGFP-N1, Clontech), are infected with either HSV1 or HSV2 to test the specific effect of over expression of these two HSV2 microRNAs on HSV2 replication. Cells transfected with pEGFP-N1 empty vector and cells transfected with a vector containing the premicroRNA in AS-orientation are used as negative controls. Northern blot analysis is carried out to confirm that the construct produces the desired HSV-2-mirs and viral load is tested by RT-PCR to evaluate the effect of over expression of HSV-microRNAs on viral replication.

SEQUENCE LISTING (15527 sequences)

SEQ ID NO: 1 - RNA, 91 nt, Hepatitis C virus
cgcucccgugguggaguccaaguggcgagcuuuggagaccuucugggcaaagcacauguggaauuucaucagcgggauacaguacuuagcg

SEQ ID NO: 2 - RNA, 133 nt, Hepatitis C virus
guagugucgcaguuacuccggaucccacaagccgucaucgacaugguggcgggggcccacuggggaguccuggcgggccuugccuacuauuccauggcggggaacugggcuaagguuuugauugugaugcuac

SEQ ID NO: 3 - RNA, 77 nt, Hepatitis C virus
gcagaggcggcuaagcguagguuggccagggggucuccccccuccuuggccagcucuucagcuagccagcugucugc

SEQ ID NO: 4 - RNA, 76 nt, Hepatitis C virus
ccucucuccuggugcccuggucgucggagucgugugugcagcaauacugcgucggcaugugggcccgggagagggg

SEQ ID NO: 5 - RNA, 67 nt, Hepatitis C virus
ucuuugcugcgccaucacaacauggucuacgccacgacaucccgcagcgcgggccugcggcagaaga

SEQ ID NO: 6 - RNA, 60 nt, Hepatitis C virus
ccugcacgccuuccccggcgccaaacuauuccaaggcgcuguggcggguggcugcugagg

SEQ ID NO: 7 - RNA, 84 nt, Hepatitis C virus
uccgggguauaccaugucacgaacgacugcuccaacucaagcauuguguuugaggcggcggacuugaucaugcauacucccggg

SEQ ID NO: 8 - RNA, 69 nt, Hepatitis C virus
uagccgcccaacucgcuccccccagcgcugcuucggcuuucgugggcgcugguaucgcuggugcggcug

SEQ ID NO: 9 - RNA, 68 nt, Hepatitis C virus
gggcgcccccauuacguacuccaccuauggcaaguuccuugccgacggugguugcuccgggggcgcuu

SEQ ID NO: 10 - RNA, 75 nt, Hepatitis C virus
gcggaguccucgcagcucuggccgcauauugccugacaacaggcagugugguuaucguggguaggaucaucuugu

SEQ ID NO: 11 - RNA, 61 nt, Hepatitis C virus
ggcagggguggcuggcgcgcucguggccuucaaggucaugagcggcgaggcgcccucugcc

SEQ ID NO: 12 - RNA, 66 nt, Hepatitis C virus
ggcgcccccauuacguacuccaccuauggcaaguuccuugccgacggugguugcuccgggggcgcu

SEQ ID NO: 13 - RNA, 55 nt, Hepatitis C virus
gggucuggcauuauugaccuugucgccauauuacaagguguuccucgcuaggcuc

SEQ ID NO: 14 - RNA, 64 nt, Hepatitis C virus
gcucaggagcaacuugaaaaagcccuggauugccaaaucuacggggccuguuacuccauugagc

SEQ ID NO: 15 - RNA, 69 nt, Hepatitis C virus
ggugguugcuccgggggcgcuuacgacaucauaaugugcgaugagugccacucaacugacucaacuacu

SEQ ID NO: 16 - RNA, 108 nt, Hepatitis C virus
cucccacgcucgcggccaggaaugcuaccauccccacuacgacaauacgacaccacgucgauuugcucguuggggcggcugcucucugcuccgcuauguacguggggg

SEQ ID NO: 17 - RNA, 96 nt, Hepatitis C virus
gcauaugcuuucuauggcgcauggccgcugcuccugcuccucuugacauuaccaccacgagcuuacgccauggaccgggagauggcugcaucgugc

SEQ ID NO: 18 - RNA, 56 nt, Hepatitis C virus
ggaggacacugugacaccaauugacaccaccgucauggcaaagaaugagguuuucu

SEQ ID NO: 19 - RNA, 99 nt, Hepatitis C virus
ucccugccauccucucuccuggugcccuggucgucggagucgugugugcagcaauacugcgucggcaugugggcccgggagagggggccgugcagugga

SEQ ID NO: 20 - RNA, 64 nt, Hepatitis C virus
ucgaggagguggcccugucgaacacuggagagauccccuucuacggcaaagccauccccaucga

SEQ ID NO: 21 - RNA, 84 nt, Hepatitis C virus
guauugcuucaccccaaguccuguugucguggggacaaccgaucgucucggcaacccuacguacagcuggggggagaacgauac

SEQ ID NO: 22 - RNA, 62 nt, Hepatitis C virus
ggaggacggcgugaacuaugcaacagggaaccugcccgguugcucuuuuucuaucuuccucu

SEQ ID NO: 23 - RNA, 57 nt, Hepatitis C virus
ggcguccacagucaaggcuaaacuucuauccauagaagaagccugccgccugacgcc

SEQ ID NO: 24 - RNA, 63 nt, Hepatitis C virus
cuccaggaucggucaccgugccacaccccaauaucgaggagguggcccugucgaacacuggag

SEQ ID NO: 25 - RNA, 64 nt, Hepatitis C virus
agguguuccucgcuaggcuccuauggugguuacaauaucuuaucaccagagcugaggcgcacuu

SEQ ID NO: 26 - RNA, 69 nt, Hepatitis C virus
gcuggcuacagcgggggagacauauaucacagccugucucgugcccgaccccgcugguucaugcugugc

SEQ ID NO: 27 - RNA, 55 nt, Hepatitis C virus
ucgaucuaccccggccacgcgucaggucaccgcauggccugggacaugaugauga

SEQ ID NO: 28 - RNA, 73 nt, Hepatitis C virus
ggcauauacagguuuguaacuccgggggaacggcccucgggcauguucgauuccucgguccugugcgagugcu

SEQ ID NO: 29 - RNA, 88 nt, Hepatitis C virus
cgugcaugcauguuagugcggaaagucgcugggggucauuauguccaaauggccuucaugagacugggcgcgcugacgggcacguacg

SEQ ID NO: 30 - RNA, 82 nt, Hepatitis C virus
gcgggaacccaggaggaugcggcgagccuacgagucuucacggaggcuaugacuagguacuccgccccccccggggacuugc

SEQ ID NO: 31 - RNA, 70 nt, Hepatitis C virus
uggaaacuacuaugcgguccccggucuucacagacaacucaucucccccggccguaccgcaaacauucca

SEQ ID NO: 32 - RNA, 122 nt, Hepatitis C virus
gcaggcggaggcugccgcucccgugguggaguccaaguggcgagcuuuggagaccuucugggcaaagcacauguggaauuucaucagcgggauacaguacuuagcgggcuuauccacccugc

SEQ ID NO: 33 - RNA, 61 nt, Hepatitis C virus
gcuggcacuacccaccucaacaaugugguaucguaccugcgucgcaggugugugguccagu

SEQ ID NO: 34 - RNA, 62 nt, Hepatitis C virus
uuaugguggcuccaucuuagcccuagucacggcuagcugugaaagguccgugagccgcauga

SEQ ID NO: 35 - RNA, 56 nt, Hepatitis C virus
uuugggacugggugugcacgguguugagugacuucaagaccuggcuccaguccaag

SEQ ID NO: 36 - RNA, 56 nt, Hepatitis C virus
ccugggccuaccugucuccgcccgaaggggaagggagauacuccuggggccggccg

SEQ ID NO: 37 - RNA, 55 nt, Hepatitis C virus
cgccugacgcccccacauucggccaaauccaaguuuggcuauggggcaaaggacg

SEQ ID NO: 38 - RNA, 58 nt, Hepatitis C virus
cggcguaggucgcguaauuuggguaaggucaucgauacccucacaugcggccucgccg

SEQ ID NO: 39 - RNA, 59 nt, Hepatitis C virus
uacugucccagggggggagggccgccacuugcggcaaauaccucuucaacugggcagua

SEQ ID NO: 40 - RNA, 81 nt, Hepatitis C virus
aagacuccgacgcugagucaugcuccucuaugcccccccuugagggggagccgggggaccccgaucucagcgacgggucuu

SEQ ID NO: 41 - RNA, 55 nt, Hepatitis C virus
ggagcucagcccgcugcugcucucuacaacagaguggcagguucugcccugcucu

SEQ ID NO: 42 - RNA, 92 nt, Hepatitis C virus
ucagcuguucaccuucucgccccgccggcaugcgacauugcaggacugcaauuguucgaucuaccccggccacgcgucaggucaccgcaugg

SEQ ID NO: 43 - RNA, 70 nt, Hepatitis C virus
uggcacuaccccugcacugucaacuucuccaucuuuaagguuaggauguauguggggggcguggagcaca

SEQ ID NO: 44 - RNA, 56 nt, Hepatitis C virus
ggucacccucacacaccccauaaccaaauacaucauggcaugcaugucggccgacc

SEQ ID NO: 45 - RNA, 55 nt, Hepatitis C virus
caagacgugcggggcccccccguguaacaucgggggggucggcaauaacaccuug

SEQ ID NO: 46 - RNA, 56 nt, Hepatitis C virus
uuggacugucuaccauggugcuggcucaaagacucuagccggcccaaaaggcccaa

SEQ ID NO: 47 - RNA, 59 nt, Hepatitis C virus
cuggcacuacccaccucaacaaugugguaucguaccugcgucgcaggugugugguccag

SEQ ID NO: 48 - RNA, 93 nt, Hepatitis C virus
uugcccguuugccaggaccaucuggaguucugggagagcgucuucacaggccucacccauauagaugcccacuuccugucccagaccaagcag

SEQ ID NO: 49 - RNA, 97 nt, Hepatitis C virus
gggccccacggacccccggcguaggucgcguaauuuggguaaggucaucgauacccucacaugcggccucgccgaccucaugggguacauuccgcuc

SEQ ID NO: 50 - RNA, 55 nt, Hepatitis C virus
caggcuggucccuggggcggcauaugcuuucuauggcgcauggccgcugcuccug

SEQ ID NO: 51 - RNA, 94 nt, Hepatitis C virus
acgcguccgggguauaccaugucacgaacgacugcuccaacucaagcauuguguuugaggcggcggacuugaucaugcauacucccgggugcgu

SEQ ID NO: 52 - RNA, 70 nt, Hepatitis C virus
aaacguaacaccaaccgccgcccacaggacgucaaguucccgggcgguggucagaucguugguggaguuu

SEQ ID NO: 53 - RNA, 92 nt, Hepatitis C virus
ggcaucggcacaguccuggaccaagcggagacggcuggagcgcggcuugucgugcucgccaccgcuacgccuccaggaucggucaccgugcc

SEQ ID NO: 54 - RNA, 56 nt, Hepatitis C virus
gccauggaccgggagauggcugcaucgugcggaggcgcgguuuuugugggucuggc

SEQ ID NO: 55 - RNA, 69 nt, Hepatitis C virus
ggcguauguuggacugucuaccauggugcuggcucaaagacucuagccggcccaaaaggcccaaucgcc

SEQ ID NO: 56 - RNA, 55 nt, Hepatitis C virus
cgagugcuaugacgcgggcugugcuugguacgagcucacccccgcugagaccucg

SEQ ID NO: 57 - RNA, 65 nt, Hepatitis C virus
cauguuacuugaaagccucugccgccugucgagcugcaaagcuccaggacugcacgaugcucgug

SEQ ID NO: 58 - RNA, 56 nt, Hepatitis C virus
aucagcgggauacaguacuuagcgggcuuauccacccugccugggaaccccgcgau

SEQ ID NO: 59 - RNA, 56 nt, Hepatitis C virus
guuaggauguauguggggggcguggagcacaggcuuaaugcugcaugcaacuggac

SEQ ID NO: 60 - RNA, 56 nt, Hepatitis C virus
ggcaaugagggcauggggugggcaggauggcuccugucaccccgcggcucccggcc

SEQ ID NO: 61 - RNA, 78 nt, Hepatitis C virus
ggcacaguccuggaccaagcggagacggcuggagcgcggcuugucgugcucgccaccgcuacgccuccaggaucgguc

SEQ ID NO: 62 - RNA, 160 nt, Hepatitis C virus
ugcagcaacacguggcauggaacauuccccaucaacgcguacaccacgggccccugcacgccuuccccggcgccaaacuauuccaaggcgcuguggcggguggcugcugaggaguacguggaggucacgcgggugggggauuuccacuacgugacgggca

SEQ ID NO: 63 - RNA, 96 nt, Hepatitis C virus
uccauaguuacucuccaggugagaucaauaggguggcuucaugccucaggaaacuugggguaccgcccuugcgagucuggagacaucgggccagga

SEQ ID NO: 64 - RNA, 56 nt, Hepatitis C virus
gggcuucucauaugacacccgcuguuuugacucaacggucacugagaaugacaucc

SEQ ID NO: 65 - RNA, 64 nt, Hepatitis C virus
uggccugggacaugaugaugaacuggucaccuacaacagcccucguagugucgcaguuacuccg

SEQ ID NO: 66 - RNA, 92 nt, Hepatitis C virus
ggucagaucguugguggaguuuaccuguugccgcgcaggggccccagguugggugugcgcgcgaucaggaagacuuccgagcggucgcaacc

SEQ ID NO: 67 - RNA, 56 nt, Hepatitis C virus
acaccuaggugcaugguugacuacccauacaggcucuggcacuaccccugcacugu

SEQ ID NO: 68 - RNA, 93 nt, Hepatitis C virus
acaggccgggacaagaaccaggucgagggggagguucaaguggucuccaccgcaacacaaucuuuccuggcgaccugcgucaacggcguaugu

SEQ ID NO: 69 - RNA, 55 nt, Hepatitis C virus
ccagcccgccuuaucguauucccagauuugggaguucguguaugcgagaagaugg

SEQ ID NO: 70 - RNA, 58 nt, Hepatitis C virus
agggggccgugcaguggaugaaccggcugauagcguucgcuucgcgggguaaccaugu

SEQ ID NO: 71 - RNA, 91 nt, Hepatitis C virus
uggggcaaaggacguccggaaccuauccagcagggccaucaaccacauccgcuccgugugggaggacuugcuggaggacacugugacacca

SEQ ID NO: 72 - RNA, 73 nt, Hepatitis C virus
augucggccgaccuggaagucgucaccagcaccugggugcugguaggcggaguccucgcagcucuggccgcau

SEQ ID NO: 73 - RNA, 55 nt, Hepatitis C virus
cugucccagggggggagggccgccacuugcggcaaauaccucuucaacugggcag

SEQ ID NO: 74 - RNA, 85 nt, Hepatitis C virus
cggugaguacaccggaauugccaggacgaccggguccuuucuuggaucaacccgcucaaugccuggagauuugggcgugcccccg

SEQ ID NO: 75 - RNA, 55 nt, Hepatitis C virus
ggagguggcccugucgaacacuggagagauccccuucuacggcaaagccaucccc

SEQ ID NO: 76 - RNA, 55 nt, Hepatitis C virus
ggaaggugcuaguggacauucuggcgggcuauggggcagggguggcuggcgcgcu

SEQ ID NO: 77 - RNA, 67 nt, Hepatitis C virus
gaaccaggucgagggggagguucaaguggucuccaccgcaacacaaucuuuccuggcgaccugcguc

SEQ ID NO: 78 - RNA, 56 nt, Hepatitis C virus
uaacuccucccgcugcuggguagcgcucacucccacgcucgcggccaggaaugcua

SEQ ID NO: 79 - RNA, 79 nt, Hepatitis C virus
ggaguaugucguguugcuuuuccuucuccuggcggacgcgcgcgucugugccugcuuguggaugaugcugcugauagcc

SEQ ID NO: 80 - RNA, 56 nt, Hepatitis C virus
cucgcagcucuggccgcauauugccugacaacaggcagugugguuaucguggguag

SEQ ID NO: 81 - RNA, 58 nt, Hepatitis C virus
gcccgcucaccacccagaacacccuccuguuuaacaucuuggggggguggguagccgc

SEQ ID NO: 82 - RNA, 55 nt, Hepatitis C virus
uacuccauugagccacuugaccuaccucagaucauugaacgacuccauggucuua

SEQ ID NO: 83 - RNA, 60 nt, Hepatitis C virus
ccgugccccaagacgcagugucgcgcucgcagcggcgggguaggacuggcaggggcaggg

SEQ ID NO: 84 - RNA, 55 nt, Hepatitis C virus
cugcuagccgaguaguguugggucgcgaaaggccuugugguacugccugauaggg

SEQ ID NO: 85 - RNA, 61 nt, Hepatitis C virus
ucuacgccguguuccggcucguggcugagggauguuugggacugggugugcacgguguuga

SEQ ID NO: 86 - RNA, 56 nt, Hepatitis C virus
guuccucgcuaggcuccuauggugguuacaauaucuuaucaccagagcugaggcgc

SEQ ID NO: 87 - RNA, 94 nt, Hepatitis C virus
guugaguccauggaaacuacuaugcgguccccggucuucacagacaacucaucucccccggccguaccgcaaacauuccaaguggcccaucuac

SEQ ID NO: 88 - RNA, 56 nt, Hepatitis C virus
ccuauccagcagggccaucaaccacauccgcuccgugugggaggacuugcuggagg

SEQ ID NO: 89 - RNA, 55 nt, Hepatitis C virus
ccuuccucguguucuucugugccgcuugguacaucaagggcaggcuggucccugg

SEQ ID NO: 90 - RNA, 56 nt, Hepatitis C virus
ccuucaccauugagacgacgaccgugccccaagacgcagugucgcgcucgcagcgg

SEQ ID NO: 91 - RNA, 56 nt, Hepatitis C virus
aagagcacuagagugccggccgcauaugcggcccaaggguacaaggugcuuguccu

SEQ ID NO: 92 - RNA, 58 nt, Hepatitis C virus
aagugcccaugucagguuccagcuccugaguuuuucacggagguggauggggugcggu

SEQ ID NO: 93 - RNA, 85 nt, Hepatitis C virus
caaagacuccgacgcugagucaugcuccucuaugcccccccuugagggggagccgggggaccccgaucucagcgacgggucuugg

SEQ ID NO: 94 - RNA, 57 nt, Hepatitis C virus
gacuugaucaugcauacucccgggugcgugcccugcguucgggaggguaacuccucc

SEQ ID NO: 95 - RNA, 59 nt, Hepatitis C virus
cauccugggccuaccugucuccgcccgaaggggaagggagauacuccuggggccggccg

SEQ ID NO: 96 - RNA, 60 nt, Hepatitis C virus
ucaucgacaugguggcgggggcccacuggggaguccuggcgggccuugccuacuauucca

SEQ ID NO: 97 - RNA, 56 nt, Hepatitis C virus
uccaaucccggcugcgucccaguuggacuuauccggcugguucguugcuggcuaca

SEQ ID NO: 98 - RNA, 60 nt, Hepatitis C virus
gcgcacuugcauguguggguucccccccucaacguccggggaggccgcgaugccaucauc

SEQ ID NO: 99 - RNA, 61 nt, Hepatitis C virus
ccuugcgcccaucacggccuacucccaacagacccggggccuacuugguugcaucaucacg

SEQ ID NO: 100 - RNA, 55 nt, Hepatitis C virus
ggagccugucgucuucucugacauggagaccaagaucaucaccuggggggcagac

SEQ ID NO: 101 - RNA, 63 nt, Hepatitis C virus
cgccggcccgagggcagggccugggcucagcccggguauccuuggccccucuauggcaaugag

SEQ ID NO: 102 - RNA, 56 nt, Hepatitis C virus
cugacgcccccacauucggccaaauccaaguuuggcuauggggcaaaggacguccg

SEQ ID NO: 103 - RNA, 57 nt, Hepatitis C virus
cuaccauccccacuacgacaauacgacaccacgucgauuugcucguuggggcggcug

SEQ ID NO: 104 - RNA, 64 nt, Hepatitis C virus
uuauaaacaccaauggcaguuggcacaucaacaggacugcccugaacugcaaugacucccucca

SEQ ID NO: 105 - RNA, 61 nt, Hepatitis C virus
cucacaacgggggggcacgcugcccgccucaccagcggguucgcgggccucuuuacaccug

SEQ ID NO: 106 - RNA, 59 nt, Hepatitis C virus
guuacuugaaagccucugccgccugucgagcugcaaagcuccaggacugcacgaugcuc

SEQ ID NO: 107 - RNA, 57 nt, Hepatitis C virus
cagcgacgggucuuggucuaccguaagcgaggaggcuagugaggacgucgucugcug

SEQ ID NO: 108 - RNA, 74 nt, Hepatitis C virus
ucccgugguggaauccaaguggcggacccucgaagccuucugggcgaagcauauguggaauuucaucagcggga

SEQ ID NO: 109 - RNA, 135 nt, Hepatitis C virus
agugguaucgcaguuacuccggaucccacaagcugucguggauaugguggcgggggcccauuggggaguccuagcgggccuugccuacuauuccaugguggggaacugggcuaagguucugauugugaugcuacu

SEQ ID NO: 110 - RNA, 103 nt, Hepatitis C virus
gcuccggcucguggcuaagagauguuugggauuggauaugcacgguguugacugauuucaagaccuggcuccaguccaagcuccugccgcgauugccgggagu

SEQ ID NO: 111 - RNA, 57 nt, Hepatitis C virus
cugacgcccccacauucggccagaucuaaauuuggcuauggggcaaaggacguccgg

SEQ ID NO: 112 - RNA, 68 nt, Hepatitis C virus
gggugcccccaucacguacuccaccuauggcaaguuucuugccgacggugguugcucugggggcgccu

SEQ ID NO: 113 - RNA, 94 nt, Hepatitis C virus
acguauccggaguguaccaugucacgaacgacugcuccaacgcaagcauuguguaugaggcagcggacaugaucaugcauacccccgggugcgu

SEQ ID NO: 114 - RNA, 87 nt, Hepatitis C virus
gggggccgcaagccagcucgccuuaucguauucccagauuuggggguucgugugugcgagaaaauggcccuuuacgauguggucucc

SEQ ID NO: 115 - RNA, 70 nt, Hepatitis C virus
cuccccuggcgcccuagucgucggggucgugugcgcagcgauacugcgucggcacgugggcccaggggag

SEQ ID NO: 116 - RNA, 81 nt, Hepatitis C virus
uccacugcucugccccucggggcacgcugugggcaucuuucgggcugccgugugcacccgagggguugcgaaggcggugga

SEQ ID NO: 117 - RNA, 81 nt, Hepatitis C virus
gaucgucgguggaguuuaccuguugccgcgcaggggccccagguugggugugcgcgcgacuaggaagacuuccgagcgguc

SEQ ID NO: 118 - RNA, 95 nt, Hepatitis C virus
cagaaggcaaucggguugcugcaaacagccaccaagcaagcggaggcugcugcucccgugguggaauccaaguggcggacccucgaagccuucug

SEQ ID NO: 119 - RNA, 66 nt, Hepatitis C virus
ugccggcccaaagggcccaaucacccaaauguacaccaauguggaccaggaccucgucggcuggca

SEQ ID NO: 120 - RNA, 108 nt, Hepatitis C virus
cucccacgcucgcggccaggaacgcuagcguccccacuacgacgauacgacgccaugucgauuugcucguuggggcggcugcucucugcuccgcuauguacgugggag

SEQ ID NO: 121 - RNA, 59 nt, Hepatitis C virus
cuaccccugcacugucaacuuuaccaucuucaagguuaggauguacguggggggagugg

SEQ ID NO: 122 - RNA, 72 nt, Hepatitis C virus
ucuccaggugagaucaauaggguggcuucaugccucaggaaacuugggguaccgcccuugcgagucuggaga

SEQ ID NO: 123 - RNA, 78 nt, Hepatitis C virus
ggauccgacguugagucguacuccuccaugcccccccuugagggggagccgggggaucccgaucucagcgacgggucu

SEQ ID NO: 124 - RNA, 84 nt, Hepatitis C virus
ccgcacuauaagcuguuccucgcuaggcucauauggugguuacaauauuuuaucaccagggccgaggcacacuugcaagugugg

SEQ ID NO: 125 - RNA, 56 nt, Hepatitis C virus
cguggguacaagggagucuggcggggcgacggcaucaugcaaaccaccugcccaug

SEQ ID NO: 126 - RNA, 145 nt, Hepatitis C virus
cacguggcauggaacauuccccauuaacgcguacaccacgggccccugcacgcccuccccggcgccaaauuauucuagggcgcuguggcggguggcugcugaggaguacguggagguuacgcgggugggggauuuccacuacgug

SEQ ID NO: 127 - RNA, 65 nt, Hepatitis C virus
uccuggaccaagcggagacggcuggagcgcgacucgucgugcucgccaccgcuacgccuccggga

SEQ ID NO: 128 - RNA, 64 nt, Hepatitis C virus
ucgaggagguggcucuguccagcacuggagaaauccccuuuuauggcaaagccauccccaucga

SEQ ID NO: 129 - RNA, 86 nt, Hepatitis C virus
auccggaguguaccaugucacgaacgacugcuccaacgcaagcauuguguaugaggcagcggacaugaucaugcauacccccgggu

SEQ ID NO: 130 - RNA, 80 nt, Hepatitis C virus
cagguuauggagcagggguggcaggcgcgcucguggccuuuaaggucaugagcggcgagaugcccuccaccgaggaccug

SEQ ID NO: 131 - RNA, 56 nt, Hepatitis C virus
gugaugagcucgccgcgaagcuguccggccucggacucaaugcuguagcauauuac

SEQ ID NO: 132 - RNA, 57 nt, Hepatitis C virus
acggcuaaagccuacgcugcacgggccaacgccccugcuguauaggcugggagccgu

SEQ ID NO: 133 - RNA, 55 nt, Hepatitis C virus
agucuuaccaucacucagcugcugaagaggcuucaccaguggaucaacgaggacu

SEQ ID NO: 134 - RNA, 125 nt, Hepatitis C virus
agcccuccgacgacggcgacgcgggauccgacguugagucguacuccuccaugcccccccuugagggggagccgggggaucccgaucucagcgacgggucuuggucuaccguaagcgaggaggcu

SEQ ID NO: 135 - RNA, 86 nt, Hepatitis C virus
ugccgacggugguugcucugggggcgccuaugacaucauaauaugugaugagugccacucaacugacucgaccacuauccugggca

SEQ ID NO: 136 - RNA, 58 nt, Hepatitis C virus
guuugggauuggauaugcacgguguugacugauuucaagaccuggcuccaguccaagc

SEQ ID NO: 137 - RNA, 74 nt, Hepatitis C virus
ggggugggggcccaucacuuacaaugagucacacagcucggaccagaggccuuauuguuggcacuacgcacccc

SEQ ID NO: 138 - RNA, 59 nt, Hepatitis C virus
gccaccgcuacgccuccgggaucggucaccgugccacauccaaacaucgaggagguggc

SEQ ID NO: 139 - RNA, 78 nt, Hepatitis C virus
ggccccucuauggcaaugagggcuuggggugggcaggauggcuccugucaccccguggcucucggccuaguuggggcc

SEQ ID NO: 140 - RNA, 97 nt, Hepatitis C virus
cccugcuauccucuccccuggcgcccuagucgucggggucgugugcgcagcgauacugcgucggcacgugggcccaggggagggggcugugcagugg

SEQ ID NO: 141 - RNA, 68 nt, Hepatitis C virus
uccaggugagaucaauaggguggcuucaugccucaggaaacuugggguaccgcccuugcgagucugga

SEQ ID NO: 142 - RNA, 63 nt, Hepatitis C virus
ggggccuguuacuccauugagccacuugaccuaccucagaucauucaacgacuccauggccuu

SEQ ID NO: 143 - RNA, 81 nt, Hepatitis C virus
uuuucuuuccuuugguggcuccaucuuagcccuagucacggcuagcugugaaagguccgugagccgcuugacugcagagag

SEQ ID NO: 144 - RNA, 93 nt, Hepatitis C virus
uccggaucccacaagcugucguggauaugguggcgggggcccauuggggaguccuagcgggccuugccuacuauuccaugguggggaacuggg

SEQ ID NO: 145 - RNA, 80 nt, Hepatitis C virus
gcacuauaagcuguuccucgcuaggcucauauggugguuacaauauuuuaucaccagggccgaggcacacuugcaagugu

SEQ ID NO: 146 - RNA, 66 nt, Hepatitis C virus
ccuccagugguacacggguguccauugccgccugccaaggccccuccgauaccaccuccacggagg

SEQ ID NO: 147 - RNA, 88 nt, Hepatitis C virus
cgugcaugcaugcuggugcggaagguugcugggggucauuauguccaaauggcucucaugaaguuggccgcacugacagguacguacg

SEQ ID NO: 148 - RNA, 55 nt, Hepatitis C virus
ggucgagggggagguccaaguggucuccaccgcaacacaaucuuuccuggcgacc

SEQ ID NO: 149 - RNA, 69 nt, Hepatitis C virus
uaaccaaagugccguacuucgugcgcgcacacgggcucauucgugcaugcaugcuggugcggaagguug

SEQ ID NO: 150 - RNA, 58 nt, Hepatitis C virus
ggcugaccuggaggucgucacgagcaccugggugcugguaggcggaguccuagcagcu

SEQ ID NO: 151 - RNA, 58 nt, Hepatitis C virus
cggcguaggucgcgcaauuuggguaaggucaucgauacccucacgugcggcuucgccg

SEQ ID NO: 152 - RNA, 55 nt, Hepatitis C virus
gauccucucuagucuuaccaucacucagcugcugaagaggcuucaccaguggauc

SEQ ID NO: 153 - RNA, 113 nt, Hepatitis C virus
ggcucuucgggcgguccacugcucugccccucggggcacgcugugggcaucuuucgggcugccgugugcacccgagggguugcgaaggcgguggacuuuguacccgucgaguc

SEQ ID NO: 154 - RNA, 96 nt, Hepatitis C virus
guacguuuaugaccaucucaccccacugcgggacugggcccacgcgggccuacgagaccuugcgguggcaguugagcccgucgucuucucugauau

SEQ ID NO: 155 - RNA, 93 nt, Hepatitis C virus
guggaagugucucauacggcuaaagccuacgcugcacgggccaacgccccugcuguauaggcugggagccguucaaaacgagguuacuaccac

SEQ ID NO: 156 - RNA, 70 nt, Hepatitis C virus
cuucaccccaagcccugucgugguggggacgaccgaccgguucggcgucccuacguacaguuggggggag

SEQ ID NO: 157 - RNA, 59 nt, Hepatitis C virus
cuacagcagcccuagugguaucgcaguuacuccggaucccacaagcugucguggauaug

SEQ ID NO: 158 - RNA, 70 nt, Hepatitis C virus
ccggaaccuauccagcaaggccguuaaccacauccgcuccguguggaaggacuugcuggaagacacugag

SEQ ID NO: 159 - RNA, 87 nt, Hepatitis C virus
aggcaaucggguugcugcaaacagccaccaagcaagcggaggcugcugcucccgugguggaauccaaguggcggacccucgaagccu

SEQ ID NO: 160 - RNA, 56 nt, Hepatitis C virus
gcugaccuggaggucgucacgagcaccugggugcugguaggcggaguccuagcagc

SEQ ID NO: 161 - RNA, 55 nt, Hepatitis C virus
aggacggcgugaacuaugcaacagggaaucugcccgguugcuccuuuucuaucuu

SEQ ID NO: 162 - RNA, 55 nt, Hepatitis C virus
cgaccagcugcgguaauacccucacauguuacuugaaggccgcugcggccugucg

SEQ ID NO: 163 - RNA, 97 nt, Hepatitis C virus
gggccccacggacccccggcguaggucgcgcaauuuggguaaggucaucgauacccucacgugcggcuucgccgaucucaugggguacauuccgcuc

SEQ ID NO: 164 - RNA, 55 nt, Hepatitis C virus
caggcuggucccuggggcggcauaugcccucuacggcguauggccgcuacuccug

SEQ ID NO: 165 - RNA, 81 nt, Hepatitis C virus
ggcggagacggcuaagcguaggcuggccaggggaucuccccccuccuuggccagcucaucagcuagccagcugucugcgcc

SEQ ID NO: 166 - RNA, 56 nt, Hepatitis C virus
uccugaacccguccgucgccgccacccuagguuucggggcguauaugucuaaggca

SEQ ID NO: 167 - RNA, 89 nt, Hepatitis C virus
agaugaaggcgaaggcguccacaguuaaggcuaaacuucuauccguggaggaagccuguaagcugacgcccccacauucggccagaucu

SEQ ID NO: 168 - RNA, 92 nt, Hepatitis C virus
ggcaucggcacaguccuggaccaagcggagacggcuggagcgcgacucgucgugcucgccaccgcuacgccuccgggaucggucaccgugcc

SEQ ID NO: 169 - RNA, 67 nt, Hepatitis C virus
cggaaccuauccagcaaggccguuaaccacauccgcuccguguggaaggacuugcuggaagacacug

SEQ ID NO: 170 - RNA, 88 nt, Hepatitis C virus
gagaucucugcggaucuguuuuccucgucgcccagcuguucaccuucucgccucgccggcacgagacaguacaggacugcaauugcuc

SEQ ID NO: 171 - RNA, 57 nt, Hepatitis C virus
uggcacuacgcaccccggccgugcgguaucguacccgcggcgcagguguguggucca

SEQ ID NO: 172 - RNA, 62 nt, Hepatitis C virus
caucgugcggaggcgcgguuuucguaggucugauacucuugaccuugucaccgcacuauaag

SEQ ID NO: 173 - RNA, 55 nt, Hepatitis C virus
gaacggggagcuaaacacuccaggccaauaggccauccuguuuuuuucccuuuuu

SEQ ID NO: 174 - RNA, 72 nt, Hepatitis C virus
uggcguguguuggacugucuaucauggugccggcucaaagacccuugccggcccaaagggcccaaucaccca

SEQ ID NO: 175 - RNA, 92 nt, Hepatitis C virus
ggucagaucgucgguggaguuuaccuguugccgcgcaggggccccagguugggugugcgcgcgacuaggaagacuuccgagcggucgcaacc

SEQ ID NO: 176 - RNA, 55 nt, Hepatitis C virus
cugucccagggggggagggcugccacuuguggcaaguaccucuucaacugggcag

SEQ ID NO: 177 - RNA, 60 nt, Hepatitis C virus
cccucccucaggccgugaugggcucuucauacggauuccaauacucuccuggacagcggg

SEQ ID NO: 178 - RNA, 56 nt, Hepatitis C virus
aauugccaggacgaccggguccuuucuuggaucaacccgcucaaugccuggagauu

SEQ ID NO: 179 - RNA, 85 nt, Hepatitis C virus; identical to SEQ ID NO: 74

SEQ ID NO: 180 - RNA, 55 nt, Hepatitis C virus
ggagguggcucuguccagcacuggagaaauccccuuuuauggcaaagccaucccc

SEQ ID NO: 181 - RNA, 56 nt, Hepatitis C virus
cuaccccugcacugucaacuuuaccaucuucaagguuaggauguacguggggggag

SEQ ID NO: 182 - RNA, 56 nt, Hepatitis C virus
ucaccauugagacgacgaccgugccacaagacgcggugucacgcucgcagcggcga

SEQ ID NO: 183 - RNA, 95 nt, Hepatitis C virus
cgagucuauggaaaccacuaugcgguccccggucuucacggacaacucguccccuccggccguaccgcagacauuccagguggcccaucuacacg

SEQ ID NO: 184 - RNA, 55 nt, Hepatitis C virus
acacugagacaccaauugacaccaccaucauggcaaaaaaugagguuuucugcgu

SEQ ID NO: 185 - RNA, 56 nt, Hepatitis C virus
ccacuacgugacgggcaugaccacugacaacguaaagugcccgugucagguuccgg

SEQ ID NO: 186 - RNA, 55 nt, Hepatitis C virus
agaucagagcuuagcccgcugcugcugucuacaacggaguggcagguauugcccu

SEQ ID NO: 187 - RNA, 78 nt, Hepatitis C virus
ggcacgugggcccaggggagggggcugugcaguggaugaaccggcugauagcguucgcuucgcgggguaaccacgucu

SEQ ID NO: 188 - RNA, 66 nt, Hepatitis C virus
gccgcuacuccugcuccugcuggcguuaccaccacgagcauacgccauggaccgggagauggcagc

SEQ ID NO: 189 - RNA, 55 nt, Hepatitis C virus
ggcacuacgcaccccggccgugcgguaucguacccgcggcgcagguguguggucc

SEQ ID NO: 190 - RNA, 56 nt, Hepatitis C virus
cucaggcuccaccuccaucgugggaccaaauguggaagugucucauacggcuaaag

SEQ ID NO: 191 - RNA, 74 nt, Hepatitis C virus
cacgggugcccccaucacguacuccaccuauggcaaguuucuugccgacggugguugcucugggggcgccuaug

SEQ ID NO: 192 - RNA, 56 nt, Hepatitis C virus
uugugggcaaggaugauccugaugacucauuucuucuccauccuucuagcucagga

SEQ ID NO: 193 - RNA, 55 nt, Hepatitis C virus
uggccggggcgcauggcauucucuccuuccucguguucuucugugcugccuggua

SEQ ID NO: 194 - RNA, 55 nt, Hepatitis C virus; identical to SEQ ID NO: 84

SEQ ID NO: 195 - RNA, 65 nt, Hepatitis C virus
gaugaacggggagcuaaacacuccaggccaauaggccauccuguuuuuuucccuuuuuuuuuuuc

SEQ ID NO: 196 - RNA, 76 nt, Hepatitis C virus
uaugacacccgcuguuuugacucaacggucacugagaaugacauccguguugaggagucaaucuaccaauguugug

SEQ ID NO: 197 - RNA, 59 nt, Hepatitis C virus
gauugccgggaguccccuucuucucaugucaacguggguacaagggagucuggcggggc

SEQ ID NO: 198 - RNA, 55 nt, Hepatitis C virus
caccuuugacagacugcagguccuggacgaccacuaccgggacgugcucaaggag

SEQ ID NO: 199 - RNA, 55 nt, Hepatitis C virus
uaggaccuguaguaacacguggcauggaacauuccccauuaacgcguacaccacg

SEQ ID NO: 200 - RNA, 57 nt, Hepatitis C virus
caaucccggcugcgucccaguuggauuuauccagcugguucguugcugguuacagcg

SEQ ID NO: 201 - RNA, 58 nt, Hepatitis C virus
caugacuccccggacgcugaccucaucgaggccaaccuccuguggcggcaggagaugg

SEQ ID NO: 202 - RNA, 55 nt, Hepatitis C virus
gcucugggggcgccuaugacaucauaauaugugaugagugccacucaacugacuc

SEQ ID NO: 203 - RNA, 55 nt, Hepatitis C virus
acaggaaccaggucgagggggagguccaaguggucuccaccgcaacacaaucuuu

SEQ ID NO: 204 - RNA, 58 nt, Hepatitis C virus
ucaucccagaaaauccagcuuguaaacaccaacggcagcuggcacaucaacaggacug

SEQ ID NO: 205 - RNA, 55 nt, Hepatitis C virus
ccucgccggcacgagacaguacaggacugcaauugcucaauauaucccggccacg

SEQ ID NO: 206 - RNA, 59 nt, Hepatitis C virus
ugcgagucuggagacaucgggccagaaguguccgcgcuaggcuacugucccaggggggg

SEQ ID NO: 207 - RNA, 58 nt, Hepatitis C virus
cuugcuccucccagcgcugcuucugcuuucguaggcgccggcaucgcuggagcggcug

SEQ ID NO: 208 - RNA, 99 nt, Hepatitis C virus
uuccugccauccucucuccuggugcccugguugucggggucgugugcgcagcaauacugcgccggcacgugggcccaggagagggggcugugcagugga

SEQ ID NO: 209 - RNA, 55 nt, Hepatitis C virus
agcgacgggucuuggucuaccgugagcgaggaggcuagugaggacgucgucugcu

SEQ ID NO: 210 - RNA, 74 nt, Hepatitis C virus
ucccgugguggaguccaaguggcgcgcucuugagaccuucugggcgaagcacauguggaauuucaucagcggga

SEQ ID NO: 211 - RNA, 72 nt, Hepatitis C virus
cccgugguggaguccaaguggcgcgcucuugagaccuucugggcgaagcacauguggaauuucaucagcggg

SEQ ID NO: 212 - RNA, 62 nt, Hepatitis C virus
aagcaccccgaggcuacuuacacaaaaugugguucagggccuugguugacaccuaggugcuu

SEQ ID NO: 213 - RNA, 78 nt, Hepatitis C virus
uggaggacagggauagaucagaacucagcccgcuguugcugucuacaacagaguggcagauacugcccuguuccuuca

SEQ ID NO: 214 - RNA, 56 nt, Hepatitis C virus
caccccgaggcuacuuacacaaaaugugguucagggccuugguugacaccuaggug

SEQ ID NO: 215 - RNA, 77 nt, Hepatitis C virus
gcagagacggccaagcguagguuggccagggggucuccccccucccuggccagcucuucagcuagccaguugucugc

SEQ ID NO: 216 - RNA, 64 nt, Hepatitis C virus
cuccggugguacacgggugcccauugccgccuaccaaggcacccccaauaccacccccacggag

SEQ ID NO: 217 - RNA, 87 nt, Hepatitis C virus
ggaggccgcaagccagcucgccuuaucguauucccagaccugggaguucgugugugcgagaagauggcccucuacgauguggucucc

SEQ ID NO: 218 - RNA, 55 nt, Hepatitis C virus
ugacgcccccacacucggccaaauccaaauauggcuauggggcaaaggacguccg

SEQ ID NO: 219 - RNA, 68 nt, Hepatitis C virus
gggcgcucccaucacguauuccaccuauggcaaguuccucgccgacggugguugcuccgggggugccu

SEQ ID NO: 220 - RNA, 80 nt, Hepatitis C virus
auguggaggcgcaguuuuuguaggauuggcauucuugacuuugucgccauacuauaaaguguuccucgcuaggcucauau

SEQ ID NO: 221 - RNA, 64 nt, Hepatitis C virus
gcucaggagcagcuugaaaaagcccuggauugccagaucuacggggccuguuacuccauugagc

SEQ ID NO: 222 - RNA, 68 nt, Hepatitis C virus
cagggguggcuggcgcacucguagcuuuuaagaucaugagcggcgagaugcccuccaccgaggaccug

SEQ ID NO: 223 - RNA, 70 nt, Hepatitis C virus
cucuccuggugcccugguugucggggucgugugcgcagcaauacugcgccggcacgugggcccaggagag

SEQ ID NO: 224 - RNA, 80 nt, Hepatitis C virus
gggauccgacguugagucauacuccuccaugcccccccuugagggagagccgggggacccugaucuuagcgacgggucuu

SEQ ID NO: 225 - RNA, 92 nt, Hepatitis C virus
gggccccacagacccccggcguaggucgcguaauuuggguaaggucaucgauacccucacaugcggcuucgccgaccucaugggguacauuc

SEQ ID NO: 226 - RNA, 57 nt, Hepatitis C virus
cagccuuaccaucacucagcugcugaagagacuucaccaguggaucaaugaggacug

SEQ ID NO: 227 - RNA, 108 nt, Hepatitis C virus
cucccacgcucgcagccaggaacaucagcguccccacuacgacaauacgacgccaugucgacuugcucguugggacggcugcuuucugcucugcuauguacguggggg

SEQ ID NO: 228 - RNA, 67 nt, Hepatitis C virus
guccuggaucaagcggagacggcuggagcgcggcucgucgugcucgccaccgcuacgccuccaggau

SEQ ID NO: 229 - RNA, 72 nt, Hepatitis C virus
ucuccaggugagaucaauaggguggcuucaugccucaggaaacuuggggucccacccuugcgagucuggaga

SEQ ID NO: 230 - RNA, 175 nt, Hepatitis C virus
agcggcacggcgacugccccuccugaccaggccuccgacgacggcgacaagggauccgacguugagucauacuccuccaugcccccccuugagggagagccgggggacccugaucuuagcgacgggucuuggucuaccgugagcgaggaggcuagugaggacgucgucugcugcu

SEQ ID NO: 231 - RNA, 145 nt, Hepatitis C virus
cacguggcauggaacauuccccaucaacgcguacaccacgggccccugcacacccuccccggcgccaaacuauuccagggcgcuguggcggguggcugcugaggaguacguggagguuacgcgggugggggauuuccacuacgug

SEQ ID NO: 232 - RNA, 55 nt, Hepatitis C virus
agccuuaccaucacucagcugcugaagagacuucaccaguggaucaaugaggacu

SEQ ID NO: 233 - RNA, 56 nt, Hepatitis C virus
uuggacuguuuuccacggugccggcucaaagacccuagccggcccaaaagguccaa

SEQ ID NO: 234 - RNA, 59 nt, Hepatitis C virus
ggaggacggcgugaauuaugcaacagggaauuugcccgguugcucuuucucuaucuucc

SEQ ID NO: 235 - RNA, 72 nt, Hepatitis C virus
caggaacaucagcguccccacuacgacaauacgacgccaugucgacuugcucguugggacggcugcuuucug

SEQ ID NO: 236 - RNA, 73 nt, Hepatitis C virus
acgugggcccaggagagggggcugugcaguggaugaaccggcugauagcguucgcuucucgggguaaccacgu

SEQ ID NO: 237 - RNA, 64 nt, Hepatitis C virus
aaguguuccucgcuaggcucauauggugguuacaauaccuuaucaccagagccgaggcgcacuu

SEQ ID NO: 238 - RNA, 63 nt, Hepatitis C virus
ccuggaucaagcggagacggcuggagcgcggcucgucgugcucgccaccgcuacgccuccagg

SEQ ID NO: 239 - RNA, 56 nt, Hepatitis C virus
gcugcgucaccacaauauggucuacgccacaacaucccguagcgcaggccugcggc

SEQ ID NO: 240 - RNA, 78 nt, Hepatitis C virus
ggccccucuauggugacgagggcauggggugggcaggauggcuccugucaccccguggcucucggccuaauuggggcc

SEQ ID NO: 241 - RNA, 68 nt, Hepatitis C virus
uccaggugagaucaauaggguggcuucaugccucaggaaacuuggggucccacccuugcgagucugga

SEQ ID NO: 242 - RNA, 59 nt, Hepatitis C virus
uacagguuugugacuccaggggaacggcccucgggcauguucgauuccucgguccugug

SEQ ID NO: 243 - RNA, 88 nt, Hepatitis C virus
cgugcaugcauguuggugcggaaagccgccgggggucauuauguccaaauggccuucgugaagcuggccgcacugacaggcacguacg

SEQ ID NO: 244 - RNA, 66 nt, Hepatitis C virus
accaaacguaacaccaaccgccgcccacaggacguuaaguucccgggcgguggucagaucguuggu

SEQ ID NO: 245 - RNA, 58 nt, Hepatitis C virus
ggcugaccuggaggucgucaccagcacuugggugcugguaggcggaguccuugcagcu

SEQ ID NO: 246 - RNA, 80 nt, Hepatitis C virus
auacuauaaaguguuccucgcuaggcucauauggugguuacaauaccuuaucaccagagccgaggcgcacuugcagaugu

SEQ ID NO: 247 - RNA, 114 nt, Hepatitis C virus
gugggaucaaauguggaagugucucacacggcuaaaaccuacacugcacgggccaacacccuugcuguauaggcuaggagccguccaaaaugaggucacccucacacaccccau

SEQ ID NO: 248 - RNA, 86 nt, Hepatitis C virus
acacgcggccuccgcaaggcaauugguucggcuguacguggaugaauaacaccggguucaccaagacgugugggggcccuccgugu

SEQ ID NO: 249 - RNA, 84 nt, Hepatitis C virus
gccgacggugguugcuccgggggugccuacgacaucauaauaugugaugagugccacucaacugacucgacuaccaucuugggc

SEQ ID NO: 250 - RNA, 61 nt, Hepatitis C virus
gcuggcacuacccaccccgaccgugugguaucguacccgcguuggaggugugugguccagu

SEQ ID NO: 251 - RNA, 56 nt, Hepatitis C virus
cauuucaaguggcucaucugcacgcccccacuggcagcggcaagagcacuaaagug

SEQ ID NO: 252 - RNA, 62 nt, Hepatitis C virus
ggcgacuucgacucagugaucgacuguaauacaugugucacucagacagucgacuucagcuu

SEQ ID NO: 253 - RNA, 82 nt, Hepatitis C virus
gaggccuuauugcuggcacuacccaccccgaccgugugguaucguacccgcguuggaggugugugguccaguguauugcuuc

SEQ ID NO: 254 - RNA, 55 nt, Hepatitis C virus
ggcagcuccggaucgucggccgccgacagcggcacggcgacugccccuccugacc

SEQ ID NO: 255 - RNA, 117 nt, Hepatitis C virus
gucguuaucugugaaagcgcgggaacccaagaggaugcggcgagccuacgagucuucacggaggcuaugacuagguauucugccccccccggggacccgccucaaccagaauacgac

SEQ ID NO: 256 - RNA, 56 nt, Hepatitis C virus
guuuaccuguugccgcgcaggggccccagguugggugugcgcgcgacuaggaagac

SEQ ID NO: 257 - RNA, 70 nt, Hepatitis C virus
cuucaccccaagcccuguugugguggggacgaccgaucguuucggcgucccuaccuauagcuggggggag

SEQ ID NO: 258 - RNA, 93 nt, Hepatitis C virus
guggaagugucucacacggcuaaaaccuacacugcacgggccaacacccuugcuguauaggcuaggagccguccaaaaugaggucacccucac

SEQ ID NO: 259 - RNA, 70 nt, Hepatitis C virus
cuggaagacacugagacaccaauugacacuaccaucauggcaaagagugagguuuucuguguccagccag

SEQ ID NO: 260 - RNA, 70 nt, Hepatitis C virus
ccggaaccuauccagcagggccgucaaccacauccgcuccgugugggaggacuugcuggaagacacugag

SEQ ID NO: 261 - RNA, 58 nt, Hepatitis C virus
ugggacuggauaugcacgguauuggcugacuuuaagaccuggcucaaguccaagcuca

SEQ ID NO: 262 - RNA, 56 nt, Hepatitis C virus
ucccaucacguauuccaccuauggcaaguuccucgccgacggugguugcuccgggg

SEQ ID NO: 263 - RNA, 71 nt, Hepatitis C virus
ugcccaacucgcuccccccagcgcugcuucugcuuuugugggcgccggcguugccggugcggcuguuggca

SEQ ID NO: 264 - RNA, 86 nt, Hepatitis C virus
cugacgggaccacccacgugacagggggggugcaagcccacggugcuuacgggcuugcaucccucuuuaacguugggccccaucag

SEQ ID NO: 265 - RNA, 79 nt, Hepatitis C virus
uauugcuucaccccaagcccuguugugguggggacgaccgaucguuucggcgucccuaccuauagcuggggggagaaug

SEQ ID NO: 266 - RNA, 93 nt, Hepatitis C virus
cacaggucgggacaagaaccagguugagggggagguucaagugguuuccaccgcuacacaaucuuuccuggcgaccugcaucaauggcgugug

SEQ ID NO: 267 - RNA, 70 nt, Hepatitis C virus
aaacguaacaccaaccgccgcccacaggacguuaaguucccgggcgguggucagaucguugguggaguuu

SEQ ID NO: 268 - RNA, 56 nt, Hepatitis C virus
ggcguaggucgcguaauuuggguaaggucaucgauacccucacaugcggcuucgcc

SEQ ID NO: 269 - RNA, 55 nt, Hepatitis C virus
cgacuagcugcgguaauacccucacauguuaucugaaagccucugcggccugucg

SEQ ID NO: 270 - RNA, 75 nt, Hepatitis C virus
ucgauuccucgguccugugugagugcuaugacgcgggcugugcgugguacgagcucacgcccgccgagaccucga

SEQ ID NO: 271 - RNA, 70 nt, Hepatitis C virus
cucacuccaauuccggcugcgucccgguuggacuuguccggcugguucgucgccgguuacagcgggggag

SEQ ID NO: 272 - RNA, 55 nt, Hepatitis C virus
ugcaaacagccaccaagcaagcggaggcugcugcucccgugguggaguccaagug

SEQ ID NO: 273 - RNA, 58 nt, Hepatitis C virus
cucaugccgcaauuaccgggagucccuuucuucucuugccaacgcggcuacaagggag

SEQ ID NO: 274 - RNA, 92 nt, Hepatitis C virus
ggucagaucguugguggaguuuaccuguugccgcgcaggggccccagguugggugugcgcgcgacuaggaagacuuccgagcggucgcaacc

SEQ ID NO: 275 - RNA, 72 nt, Hepatitis C virus
ucccacccuugcgagucuggagacaucgggccagaaguguccgcgcuaaguuacugucccagggggggaggg

SEQ ID NO: 276 - RNA, 71 nt, Hepatitis C virus
cacccgcuguuuugacucaacggucacugagaaugacauccguguugaggagucaauuuaccaaugcugug

SEQ ID NO: 277 - RNA, 91 nt, Hepatitis C virus
ggagaugaaggcgaaggcguccacaguuaaggcuaagcuucuaucuauagaagaagccugcaaacugacgcccccacacucggccaaaucc

SEQ ID NO: 278 - RNA, 57 nt, Hepatitis C virus
acugcaaugacacccuccagaccggauuccuugccgcgcuguucuacaaacacaggu

SEQ ID NO: 279 - RNA, 55 nt, Hepatitis C virus
cugucccagggggggagggccgccacuuguggcaaguaccucuucaacugggcag

SEQ ID NO: 280 - RNA, 85 nt, Hepatitis C virus
cggugaguacaccggaauugccaggacgaccggguccuuucuuggauuaacccgcucaaugccuggagauuugggcgugcccccg

SEQ ID NO: 281 - RNA, 60 nt, Hepatitis C virus
ucuugccccacugcaacauugggcccacacgggccuacgagaccuugcgguggcaguaga

SEQ ID NO: 282 - RNA, 60 nt, Hepatitis C virus
ggcuucgccgaccucaugggguacauuccgcuugucggcgccccucuaggaggcguugcc

SEQ ID NO: 283 - RNA, 56 nt, Hepatitis C virus
cucuucgggugguccgcugcucugcccuucggggcaugccgugggcaucuuccggg

SEQ ID NO: 284 - RNA, 56 nt, Hepatitis C virus
uuaugggcaaggaugauucugaugacccacuucuucuccauccuucuagcucagga

SEQ ID NO: 285 - RNA, 156 nt, Hepatitis C virus
ccacgccaugcuccggcucguggcuaagggauauuugggacuggauaugcacgguauuggcugacuuuaagaccuggcucaaguccaagcucaugccgcaauuaccgggagucccuuucuucucuugccaacgcggcuacaagggagucuggcggg

SEQ ID NO: 286 - RNA, 63 nt, Hepatitis C virus
ccaccgaggaccuggucaauuuacuuccugccauccucucuccuggugcccugguugucgggg

SEQ ID NO: 287 - RNA, 75 nt, Hepatitis C virus
acaccacgggccccugcacacccuccccggcgccaaacuauuccagggcgcuguggcggguggcugcugaggagu

SEQ ID NO: 288 - RNA, 55 nt, Hepatitis C virus
ggaaggugcuuguggacauccuggcgggcuauggggcagggguggcuggcgcacu

SEQ ID NO: 289 - RNA, 67 nt, Hepatitis C virus
gaaccagguugagggggagguucaagugguuuccaccgcuacacaaucuuuccuggcgaccugcauc

SEQ ID NO: 290 - RNA, 56 nt, Hepatitis C virus
ggaccaucuggaguucugggagagugucuucacaggccucacccauauagaugccc

SEQ ID NO: 291 - RNA, 56 nt, Hepatitis C virus
guacgagcucacgcccgccgagaccucgauuagguugcgggcguaccuaaauacac

SEQ ID NO: 292 - RNA, 55 nt, Hepatitis C virus
ggaugcggcgagccuacgagucuucacggaggcuaugacuagguauucugccccc

SEQ ID NO: 293 - RNA, 66 nt, Hepatitis C virus
gccgcugcuucugcuccuguuggcguugccgccacgugcuuacgccauggaccgggagauggcugc

SEQ ID NO: 294 - RNA, 105 nt, Hepatitis C virus
ggcucauucgugcaugcauguuggugcggaaagccgccgggggucauuauguccaaauggccuucgugaagcuggccgcacugacaggcacguacguuuaugacc

SEQ ID NO: 295 - RNA, 56 nt, Hepatitis C virus
uccauggucuuagcgcauuuucacuccauaguuacucuccaggugagaucaauagg

SEQ ID NO: 296 - RNA, 55 nt, Hepatitis C virus
ugcuuaguugacuaccccuauaggcucuggcacuaccccugcacugucaacuuua

SEQ ID NO: 297 - RNA, 55 nt, Hepatitis C virus; identical to SEQ ID NO: 84

SEQ ID NO: 298 - RNA, 83 nt, Hepatitis C virus
gggaaguucuuuaccgggaguucgaugagauggaagagugcgccucacaccucccuuacaucgaacagggaaugcagcucgcc

SEQ ID NO: 299 - RNA, 96 nt, Hepatitis C virus
gcuccggaucccacaagcuaucguggauaugguggcgggggcccacuggggaguccuggcgggccuugccuacuauuccaugguggggaacugggc

SEQ ID NO: 300 - RNA, 56 nt, Hepatitis C virus
cuugcagcucuggccgcguauugccugacaacaggcagcguagucauugugggcag

SEQ ID NO: 301 - RNA, 56 nt, Hepatitis C virus
ugucacgaacgacugcuccaacucaagcauuguguaugaggcagcggacaucauca

SEQ ID NO: 302 - RNA, 135 nt, Hepatitis C virus
aguggugucgcaguugcuccggaucccacaagcuaucguggauaugguggcgggggcccacuggggaguccuggcgggccuugccuacuauuccaugguggggaacugggccaagguuuugauugugaugcugcu

SEQ ID NO: 303 - RNA, 55 nt, Hepatitis C virus
guuuuccucgucucccagcuguucaccuucucaccucgccggcaugaaacaguac

SEQ ID NO: 304 - RNA, 55 nt, Hepatitis C virus
gauagaucagaacucagcccgcuguugcugucuacaacagaguggcagauacugc

SEQ ID NO: 305 - RNA, 57 nt, Hepatitis C virus
gaauuucaucagcgggauacaguauuuagcaggcuuauccacucugccugggaaccc

SEQ ID NO: 306 - RNA, 57 nt, Hepatitis C virus
caauuccggcugcgucccgguuggacuuguccggcugguucgucgccgguuacagcg

SEQ ID NO: 307 - RNA, 59 nt, Hepatitis C virus
uacgcuccggcguguaaaccucuccuacgggaugaggucacauuccaggucgggcucaa

SEQ ID NO: 308 - RNA, 59 nt, Hepatitis C virus
ccauugacaaguucgcucagggauggggucccaucacuuaugcugagccugacaggcug

SEQ ID NO: 309 - RNA, 55 nt, Hepatitis C virus
gcaccccaauaucgaggagguggcccuguccaacacuggagagauccccuucuau

SEQ ID NO: 310 - RNA, 63 nt, Hepatitis C virus
gcagaacugcgguuaucgccggugccgcgcgagcggcgugcugacgacuagcugcgguaauac

SEQ ID NO: 311 - RNA, 59 nt, Hepatitis C virus
accagccgauagucuugaggggcagggguggcgacuccucgcgcccaucacggcuuacu

SEQ ID NO: 312 - RNA, 56 nt, Hepatitis C virus
ccugacagaguccaccgugucuucugccuuggcggagcucgcuacuaagaccuucg

SEQ ID NO: 313 - RNA, 55 nt, Hepatitis C virus
ucuaaggcauaugguaccgaccccaacaucagaacugggguaaggaccaucacca

SEQ ID NO: 314 - RNA, 76 nt, Hepatitis C virus
cgcuaaguuacugucccagggggggagggccgccacuuguggcaaguaccucuucaacugggcaguaaagaccaag

SEQ ID NO: 315 - RNA, 60 nt, Hepatitis C virus
cguugccgccacgugcuuacgccauggaccgggagauggcugcaucauguggaggcgcag

SEQ ID NO: 316 - RNA, 56 nt, Hepatitis C virus
guuacuccauugagccacuugaccuaccucagaucauugagcggcuccauggucuu

SEQ ID NO: 317 - RNA, 59 nt, Hepatitis C virus
guucuaucuaucccggccauauaacgggucaucgcauggcaugggauaugaugaugaac

SEQ ID NO: 318 - RNA, 56 nt, Hepatitis C virus
uacagcgggggagacauuuaucacagcgugucucaugcccggccccgcugguucug

SEQ ID NO: 319 - RNA, 83 nt, Hepatitis C virus
gaguaggacuccacgaguacccgguggggucgcaauuaccuugcgagcccgaaccggacguagccguguugacguccaugcuc

SEQ ID NO: 320 - RNA, 57 nt, Hepatitis C virus
uuugggagggcgucuuuacgggccucacucauauagaugcccacuuucuaucccaga

SEQ ID NO: 321 - RNA, 55 nt, Hepatitis C virus
gagcaccaaggucccggcugcguacgcagcccagggcuacaagguguuggugcuc

SEQ ID NO: 322 - RNA, 77 nt, Hepatitis C virus
ggcggcguccuggcugcucuggccgcguauugccugucaacaggcugcguggucauagugggcaggauugucuuguc

SEQ ID NO: 323 - RNA, 70 nt, Hepatitis C virus
uggacgcggggcgaacgcugugaucuggaagacagggacagguccgagcucagcccauugcugcugucca

SEQ ID NO: 324 - RNA, 62 nt, Hepatitis C virus
cuucuguccagaggaggcagggcugccauauguggcaaguaccucuucaacugggcaguaag

SEQ ID NO: 325 - RNA, 56 nt, Hepatitis C virus
acccaaggguccugucauccagauguauaccaauguggaccaagaccuugugggcu

SEQ ID NO: 326 - RNA, 70 nt, Hepatitis C virus
cucgccuggagcccuuguagucgguguggucugcgcagcaauacugcgccggcacguuggcccgggcgag

SEQ ID NO: 327 - RNA, 79 nt, Hepatitis C virus
caaggggggaaaacugcggcuaccgcaggugccgcgcgagcggcguacugacaacuagcugugguaacacccucacuug

SEQ ID NO: 328 - RNA, 72 nt, Hepatitis C virus
uugcuacaucaaggcccgggcagccugucgagccgcagggcuccaggacugcaccaugcucguguguggcga

SEQ ID NO: 329 - RNA, 72 nt, Hepatitis C virus
ucuccaggugaaaucaauaggguggccgcaugccucagaaaacuuggggucccgcccuugcgagcuuggaga

SEQ ID NO: 330 - RNA, 81 nt, Hepatitis C virus
uccgcuguugugccccgcgggacacgccgugggccuauucagggccgcggugugcacccguggaguggcuaaggcggugga

SEQ ID NO: 331 - RNA, 83 nt, Hepatitis C virus
cggcagcgguaagagcaccaaggucccggcugcguacgcagcccagggcuacaagguguuggugcucaaccccucuguugcug

SEQ ID NO: 332 - RNA, 80 nt, Hepatitis C virus
ggggguccaggaggacgcggcgagccugagagccuucacggaggcuaugaccagguacuccgccccccccggggaccccc

SEQ ID NO: 333 - RNA, 58 nt, Hepatitis C virus
cucguaugauacccgcuguuuugacuccacagucacugagagcgacauccguacggag

SEQ ID NO: 334 - RNA, 57 nt, Hepatitis C virus
ggauuccaauacucaccaggacagcggguugaauuccucgugcaagcguggaagucc

SEQ ID NO: 335 - RNA, 56 nt, Hepatitis C virus
gagacugggcgcacaacggccugcgagaucuggccguggcuguggaaccagucguc

SEQ ID NO: 336 - RNA, 96 nt, Hepatitis C virus
aagcggccucgacgaacgccccuacugcuggcacuacccuccaagaccuuguggcauugugcccgcaaagagcguguguggcccgguauauugcuu

SEQ ID NO: 337 - RNA, 62 nt, Hepatitis C virus
ggaguuuacuuguugccgcgcaggggcccuagauugggugugcgcgcgacgaggaagacuuc

SEQ ID NO: 338 - RNA, 58 nt, Hepatitis C virus
guggagaaccuagagacaaccaugagauccccgguguucacggacaacuccucuccac

SEQ ID NO: 339 - RNA, 117 nt, Hepatitis C virus
aggcuccucgggggguccgcuguugugccccgcgggacacgccgugggccuauucagggccgcggugugcacccguggaguggcuaaggcgguggacuuuaucccuguggagaaccu

SEQ ID NO: 340 - RNA, 68 nt, Hepatitis C virus
gccauccugcacacuccggggugugucccuugcguucgcgaggguaacgccucgagguguuggguggc

SEQ ID NO: 341 - RNA, 67 nt, Hepatitis C virus
ugcgcguucaaggccuucuccggaucugcgcgcuagcgcggaagauagccggaggucauuacgugca

SEQ ID NO: 342 - RNA, 74 nt, Hepatitis C virus
gucguaagccagcucgucucaucguguuccccgaccugggcgugcgcgugugcgagaagauggcccuguacgac

SEQ ID NO: 343 - RNA, 161 nt, Hepatitis C virus
acgacaacauccucugagcccgccccuucuggcugcccccccgacuccgacguugaguccuauucuuccaugcccccccuggagggggagccuggggauccggaucucagcgacgggucauggucgacggucaguaguggggccgacacggaagaugucgu

SEQ ID NO: 344 - RNA, 57 nt, Hepatitis C virus
ggccucagcgcauuuucacuccacaguuacucuccaggugaaaucaauaggguggcc

SEQ ID NO: 345 - RNA, 59 nt, Hepatitis C virus
ggaagacggcgugaacuaugcaacagggaaccuuccugguugcucuuucucuaucuucc

SEQ ID NO: 346 - RNA, 91 nt, Hepatitis C virus
ggaggucaaagcagcggcgucaaaagugaaggcuaacuugcuauccguagaggaagcuugcagccugacgcccccacauucagccaaaucc

SEQ ID NO: 347 - RNA, 70 nt, Hepatitis C virus
cgccaucggcagcguuggacuggggaagguccucguggacauucuugcaggguauggcgcgggcguggcg

SEQ ID NO: 348 - RNA, 56 nt, Hepatitis C virus
cccgggcgagggggcagugcaauggaugaaccggcuaauagccuucgccucccggg

SEQ ID NO: 349 - RNA, 55 nt, Hepatitis C virus
guacuuguacgggguagggucaagcaucgcguccugggccauuaagugggaguac

SEQ ID NO: 350 - RNA, 62 nt, Hepatitis C virus
cuugugucaucggaggggugggcaacaacaccuugcucugccccacugauuguuuccgcaag

SEQ ID NO: 351 - RNA, 78 nt, Hepatitis C virus
ggccccucuauggcaaugaggguugcgggugggcgggauggcuccugucuccccguggcucucggccuagcuggggcc

SEQ ID NO: 352 - RNA, 119 nt, Hepatitis C virus
agucguuaucugugaaagugcggggguccaggaggacgcggcgagccugagagccuucacggaggcuaugaccagguacuccgccccccccggggaccccccacaaccagaauacgacu

SEQ ID NO: 353 - RNA, 66 nt, Hepatitis C virus
accaaacguaacaccaaccgucgcccacaggacgucaaguucccggguggcggucagaucguuggu

SEQ ID NO: 354 - RNA, 70 nt, Hepatitis C virus
uuagcaagcucccccuggccgugaugggaagcuccuacggauuccaauacucaccaggacagcggguuga

SEQ ID NO: 355 - RNA, 56 nt, Hepatitis C virus
gcaggaacauguggagugggacguuccccauuaacgccuacaccacgggccccugu

SEQ ID NO: 356 - RNA, 60 nt, Hepatitis C virus
guaccacuccaugcuccgguuccuggcuaagggacaucugggacuggauaugcgaggugc

SEQ ID NO: 357 - RNA, 72 nt, Hepatitis C virus
cagggacggcaaacuccccacaacgcagcuucgacgucauaucgaucugcuugucgggagcgccacccucug

SEQ ID NO: 358 - RNA, 55 nt, Hepatitis C virus
ccgcuaccgccuuugugggcgcuggcuuagcuggcgccgccaucggcagcguugg

SEQ ID NO: 359 - RNA, 76 nt, Hepatitis C virus
acagcagaggcggccgggagaagguuggcgagagggucacccccuucuauggccagcuccucggccagccagcugu

SEQ ID NO: 360 - RNA, 75 nt, Hepatitis C virus
guggccgcgucguguggcggcguuguucuugucggguuaauggcgcugacucugucgccauauuacaagcgcuac

SEQ ID NO: 361 - RNA, 60 nt, Hepatitis C virus
uccuggcugcucuggccgcguauugccugucaacaggcugcguggucauagugggcagga

SEQ ID NO: 362 - RNA, 109 nt, Hepatitis C virus
ggagguaucauucagaguaggacuccacgaguacccgguggggucgcaauuaccuugcgagcccgaaccggacguagccguguugacguccaugcucacugaucccucc

SEQ ID NO: 363 - RNA, 55 nt, Hepatitis C virus
caauguggaccaagaccuugugggcuggcccgcuccucaagguucccgcucauug

SEQ ID NO: 364 - RNA, 55 nt, Hepatitis C virus
cugccugggauucccuuuguguccugccagcgcggguauaggggggucuggcgag

SEQ ID NO: 365 - RNA, 56 nt, Hepatitis C virus
ucaaguuaggggcgcuuacuggcaccuauguguauaaccaucucaccccucuucga

SEQ ID NO: 366 - RNA, 100 nt, Hepatitis C virus
acgccuucuacgggauguggccucuccuccugcuccugcuggcguugccucagcgggcauacgcacuggacacggagguggccgcgucguguggcggcgu

SEQ ID NO: 367 - RNA, 93 nt, Hepatitis C virus
ucccauccuaacaucgaggagguugcucuguccaccaccggagagaucccuuuuuacggcaaggcuaucccccucgaggugaucaagggggga

SEQ ID NO: 368 - RNA, 71 nt, Hepatitis C virus
ggccagcugccgacgccuuaccgauuuugcccagggcugggguccuaucaguuaugccaacggaagcggcc

SEQ ID NO: 369 - RNA, 55 nt, Hepatitis C virus
cccuaacucgaguauuguguacgaggcggccgaugccauccugcacacuccgggg

SEQ ID NO: 370 - RNA, 72 nt, Hepatitis C virus
ugccacaacugccugggauucccuuuguguccugccagcgcggguauaggggggucuggcgaggagacggca

SEQ ID NO: 371 - RNA, 77 nt, Hepatitis C virus
gccuaccaagugcgcaauuccucggggcuuuaccaugucaccaaugauugcccuaacucgaguauuguguacgaggc

SEQ ID NO: 372 - RNA, 56 nt, Hepatitis C virus
ccaucgugggaccagauguggaaguguuugauccgccuuaaacccacccuccaugg

SEQ ID NO: 373 - RNA, 55 nt, Hepatitis C virus
aagacggcgugaacuaugcaacagggaaccuuccugguugcucuuucucuaucuu

SEQ ID NO: 374 - RNA, 62 nt, Hepatitis C virus
auagcacggccuugaacugcaaugaaagccuuaacaccggcugguuagcagggcucuucuau

SEQ ID NO: 375 - RNA, 97 nt, Hepatitis C virus
gggccccacagacccccggcguaggucgcgcaauuuggguaaggucaucgauacccuuacgugcggcuucgccgaccucaugggguacauaccgcuc

SEQ ID NO: 376 - RNA, 143 nt, Hepatitis C virus
auguggagugggacguuccccauuaacgccuacaccacgggccccuguacuccccuuccugcgccgaacuauaaguucgcgcuguggagggugucugcagaggaauacguggagauaaggcgggugggggacuuccacuacgu

SEQ ID NO: 377 - RNA, 70 nt, Hepatitis C virus
aaacguaacaccaaccgucgcccacaggacgucaaguucccggguggcggucagaucguugguggaguuu

SEQ ID NO: 378 - RNA, 56 nt, Hepatitis C virus
ggcguaggucgcgcaauuuggguaaggucaucgauacccuuacgugcggcuucgcc

SEQ ID NO: 379 - RNA, 58 nt, Hepatitis C virus
ugucuuucuuguuggucaacuguuuaccuucucucccaggcgccacuggacgacgcaa

SEQ ID NO: 380 - RNA, 59 nt, Hepatitis C virus
guguucuucugcuuugcgugguaucugaaggguaggugggugcccggagcggucuacgc

SEQ ID NO: 381 - RNA, 74 nt, Hepatitis C virus
uugcuucacucccagccccgugguggugggaacgaccgacaggucgggcgcgccuaccuacagcuggggugcaa

SEQ ID NO: 382 - RNA, 95 nt, Hepatitis C virus
cgccuucuacgggauguggccucuccuccugcuccugcuggcguugccucagcgggcauacgcacuggacacggagguggccgcgucguguggcg

SEQ ID NO: 383 - RNA, 70 nt, Hepatitis C virus
cucacuccaauagcggccgcuggccggcuggacuuguccgguugguucacggcuggcuacagcgggggag

SEQ ID NO: 384 - RNA, 55 nt, Hepatitis C virus
gccauuaccaggacgugcucaaggaggucaaagcagcggcgucaaaagugaaggc

SEQ ID NO: 385 - RNA, 56 nt, Hepatitis C virus
agcagagacugcgggggcgagacugguugugcucgccacugcuaccccuccgggcu

SEQ ID NO: 386 - RNA, 58 nt, Hepatitis C virus
accagcagugccccagagcuuccagguggcccaccugcaugcucccaccggcagcggu

SEQ ID NO: 387 - RNA, 57 nt, Hepatitis C virus
ggcaaacuccccacaacgcagcuucgacgucauaucgaucugcuugucgggagcgcc

SEQ ID NO: 388 - RNA, 56 nt, Hepatitis C virus
uggagcugagaucacuggacaugucaaaaacgggacgaugaggaucgucgguccua

SEQ ID NO: 389 - RNA, 56 nt, Hepatitis C virus
uagagacguggaaaaagccugacuacgaaccaccugugguccauggcugcccgcua

SEQ ID NO: 390 - RNA, 56 nt, Hepatitis C virus
gggauacaauacuuggcgggccugucaacgcugccugguaaccccgccauugcuuc

SEQ ID NO: 391 - RNA, 67 nt, Hepatitis C virus
gcucgccgcccccggugccgcuaccgccuuugugggcgcuggcuuagcuggcgccgccaucggcagc

SEQ ID NO: 392 - RNA, 92 nt, Hepatitis C virus
ggucagaucguugguggaguuuacuuguugccgcgcaggggcccuagauugggugugcgcgcgacgaggaagacuuccgagcggucgcaacc

SEQ ID NO: 393 - RNA, 56 nt, Hepatitis C virus
acacccugcaccugcggcuccucggaccuuuaccuggucacgaggcacgccgaugu

SEQ ID NO: 394 - RNA, 79 nt, Hepatitis C virus
caucuugaauuuugggagggcgucuuuacgggccucacucauauagaugcccacuuucuaucccagacaaagcagagug

SEQ ID NO: 395 - RNA, 86 nt, Hepatitis C virus
cagggagguucucuaccaggaguucgaugagauggaagagugcucucagcacuuaccguacaucgagcaagggaugaugcucgcug

SEQ ID NO: 396 - RNA, 146 nt, Hepatitis C virus
gcguuggugguagcucagcugcuccggaucccacaagccaucauggacaugaucgcuggugcucacuggggaguccuggcgggcauagcguauuucuccaugguggggaacugggcgaagguccugguagugcugcugcuauuugc

SEQ ID NO: 397 - RNA, 85 nt, Hepatitis C virus
cggugaguacaccggaauugccaggacgaccggguccuuucuuggauaaacccgcucaaugccuggagauuugggcgugcccccg

SEQ ID NO: 398 - RNA, 67 nt, Hepatitis C virus
guagagacguggaaaaagccugacuacgaaccaccugugguccauggcugcccgcuaccaccuccac

SEQ ID NO: 399 - RNA, 55 nt, Hepatitis C virus
ccaucacguacuccaccuacggcaaguuccuugccgacggcgggugcucaggagg

SEQ ID NO: 400 - RNA, 70 nt, Hepatitis C virus
ccaucaagucccucacugagaggcuuuauguugggggcccucuuaccaauucaaggggggaaaacugcgg

SEQ ID NO: 401 - RNA, 62 nt, Hepatitis C virus
ccccuguacuccccuuccugcgccgaacuauaaguucgcgcuguggagggugucugcagagg

SEQ ID NO: 402 - RNA, 85 nt, Hepatitis C virus
ccccgacuccgacguugaguccuauucuuccaugcccccccuggagggggagccuggggauccggaucucagcgacgggucaugg

SEQ ID NO: 403 - RNA, 56 nt, Hepatitis C virus
gccccuacugcuggcacuacccuccaagaccuuguggcauugugcccgcaaagagc

SEQ ID NO: 404 - RNA, 55 nt, Hepatitis C virus
ggcccugcucucuugccugacugugcccgcuucagccuaccaagugcgcaauucc

SEQ ID NO: 405 - RNA, 55 nt, Hepatitis C virus
gugagugcuaugacgcgggcugugcuugguaugagcucacgcccgccgagacuac

SEQ ID NO: 406 - RNA, 55 nt, Hepatitis C virus; identical to SEQ ID NO: 84

SEQ ID NO: 407 - RNA, 78 nt, Hepatitis C virus
gcgcuaggcuucuguccagaggaggcagggcugccauauguggcaaguaccucuucaacugggcaguaagaacaaagc

SEQ ID NO: 408 - RNA, 55 nt, Hepatitis C virus
gggcuccgucacugugucccauccuaacaucgaggagguugcucuguccaccacc

SEQ ID NO: 409 - RNA, 71 nt, Hepatitis C virus
ugucggccgaccuggaggucgucacgagcaccugggugcucguuggcggcguccuggcugcucuggccgcg

SEQ ID NO: 410 - RNA, 96 nt, Hepatitis C virus
gcuccggaucccacaagccaucauggacaugaucgcuggugcucacuggggaguccuggcgggcauagcguauuucuccaugguggggaacugggc

SEQ ID NO: 411 - RNA, 92 nt, Hepatitis C virus
gcuucagccuaccaagugcgcaauuccucggggcuuuaccaugucaccaaugauugcccuaacucgaguauuguguacgaggcggccgaugc

SEQ ID NO: 412 - RNA, 175 nt, Hepatitis C virus
ucuacagauuuguggcaccgggggagcgccccuccggcauguucgacucguccguccucugugagugcuaugacgcgggcugugcuugguaugagcucacgcccgccgagacuacaguuaggcuacgagcguacaugaacaccccggggcuucccgugugccaggaccaucuuga

SEQ ID NO: 413 - RNA, 56 nt, Hepatitis C virus
ucuaucagcacaaauucaacucuucaggcuguccugagagguuggccagcugccga

SEQ ID NO: 414 - RNA, 77 nt, Hepatitis C virus
cuucgugcgcguucaaggccuucuccggaucugcgcgcuagcgcggaagauagccggaggucauuacgugcaaaugg

SEQ ID NO: 415 - RNA, 56 nt, Hepatitis C virus
cuuggccgagcuugccaccaaaaguuuuggcagcuccucaacuuccggcauuacgg

SEQ ID NO: 416 - RNA, 97 nt, Hepatitis C virus
cauggucgacuacccguauaggcuuuggcacuauccuuguaccaucaauuacaccauauucaaagucaggauguacgugggaggggucgagcacagg

SEQ ID NO: 417 - RNA, 57 nt, Hepatitis C virus
caauagcggccgcuggccggcuggacuuguccgguugguucacggcuggcuacagcg

SEQ ID NO: 418 - RNA, 55 nt, Hepatitis C virus
gaagaugucgugugcugcucaaugucuuauuccuggacaggcgcacucgucaccc

SEQ ID NO: 419 - RNA, 75 nt, Hepatitis C virus
caccccucuucgagacugggcgcacaacggccugcgagaucuggccguggcuguggaaccagucgucuucucccg

SEQ ID NO: 420 - RNA, 64 nt, Hepatitis C virus
gacccuaccuuuaccauugagacaaccacgcucccccaggaugcugucuccaggacucaacgcc

SEQ ID NO: 421 - RNA, 57 nt, Hepatitis C virus
uauuugacaucaccaaacuacuccuggccaucuucggaccccuuuggauucuucaag

SEQ ID NO: 422 - RNA, 61 nt, Hepatitis C virus
gaugaacugguccccuacggcagcguuggugguagcucagcugcuccggaucccacaagcc

SEQ ID NO: 423 - RNA, 56 nt, Hepatitis C virus
ucaaggcccgggcagccugucgagccgcagggcuccaggacugcaccaugcucgug

SEQ ID NO: 424 - RNA, 56 nt, Hepatitis C virus
gcacggccuugaacugcaaugaaagccuuaacaccggcugguuagcagggcucuuc

SEQ ID NO: 425 - RNA, 60 nt, Hepatitis C virus
ucagcuggugcaugugguggcuucaguauuuucugaccagaguagaagcgcaacugcacg

SEQ ID NO: 426 - RNA, 56 nt, Hepatitis C virus
gcauugggcaucaaugccguggccuacuaccgcggucuugacgugucugucauccc

SEQ ID NO: 427 - RNA, 63 nt, Hepatitis C virus
ggaaaacugcggcuaccgcaggugccgcgcgagcggcguacugacaacuagcugugguaacac

SEQ ID NO: 428 - RNA, 59 nt, Hepatitis C virus
ugggcaauugguucgguuguaccuggaugaacucaacuggauucaccaaagugugcgga

SEQ ID NO: 429 - RNA, 57 nt, Hepatitis C virus
guccaugcucacugaucccucccauauaacagcagaggcggccgggagaagguuggc

SEQ ID NO: 430 - RNA, 65 nt, Hepatitis C virus
auacucaaugcagcaucccuggccgggacgcacggucuuguguccuuccucguguucuucugcuu

SEQ ID NO: 431 - RNA, 65 nt, Hepatitis C virus
auucccgugcgccggcgaggugauagcagggguagccugcuuucgccccggcccauuuccuacuu

SEQ ID NO: 432 - RNA, 65 nt, Human herpesvirus 4
acuaacccuaauucgauagcauaugcuucccguuggguaacauaugcuauugaauuaggguuagu

SEQ ID NO: 433 - RNA, 56 nt, Human herpesvirus 4
aucccugaggcccuucuuccuuuuaacgggaggaagaaaggugggcuuugaggggu

SEQ ID NO: 434 - RNA, 99 nt, Human herpesvirus 4
gcggggaggugcucgcggucucuggcccaacggccaccuuugccuucguggaagagcugguggccgacacuuaucuggcccggugggacgccuucccgc

SEQ ID NO: 435 - RNA, 70 nt, Human herpesvirus 4
cgccgcaggggugguggaugugcgggggccucagcccccccugugcuucuaccaagacucccugacggug

SEQ ID NO: 436 - RNA, 134 nt, Human herpesvirus 4
ggguagcauaugcuauccuaauagagauuaggguaguauaugcuauccuaauuuauaucuggguagcauauacuacccaaauaucuggauagcauaugcuauccuaaucuauaucuggguagcauaugcuaucc

SEQ ID NO: 437 - RNA, 59 nt, Human herpesvirus 4
uggacgcagcacuuaucagcgcuggaggcacgggggcaaaggucaaguagcugcgucca

SEQ ID NO: 438 - RNA, 73 nt, Human herpesvirus 4
guuguguacgacgaugaugucauagaggugauugauguugaaaccaccgaagauucaucgucagugucacagc

SEQ ID NO: 439 - RNA, 56 nt, Human herpesvirus 4
agacaggggaggggguuuggauccucgggucaaugacaccuucauaucccuuguuu

SEQ ID NO: 440 - RNA, 200 nt, Human herpesvirus 4
uggguaguauaugcuacccagauauaaauuaggauagcauauacuacccuaaucucuauuaggauagcauaugcuacccggauacagauuaggauagcauauacuacccagauauagauuaggauagcauaugcuacccagauauagauuaggauagccuaugcuacccagauauaaauuaggauagcauauacuaccca

SEQ ID NO: 441 - RNA, 56 nt, Human herpesvirus 4
gccacguagccuauuugcacguuggagagauucgagaggaugaggcugaugauggc

SEQ ID NO: 442 - RNA, 55 nt, Human herpesvirus 4
gacgcagcacuuaucagcgcuggaggcacgggggcaaaggucaaguagcugcguc

SEQ ID NO: 443 - RNA, 56 nt, Human herpesvirus 4
ccugacaucugugacgcacggucaugcacauccauauaaauucuucgauguucagg

SEQ ID NO: 444 - RNA, 65 nt, Human herpesvirus 4
acuaacccuaauucaauagcauauguuacccaacgggaagcauaugcuaucgaauuaggguuagu

SEQ ID NO: 445 - RNA, 82 nt, Human herpesvirus 4
gauggcggcagagauggaggcccuggccgcucgugugcaggaggcggcggggagccgggcauccuucucuccagccgccauc

SEQ ID NO: 446 - RNA, 92 nt, Human herpesvirus 4
aagcagguguggaauucaauaucaucaacuuuauugucgggcguauuaucaguggguggaauggagggggacacacuucuacaccuuugcuu

SEQ ID NO: 447 - RNA, 56 nt, Human herpesvirus 4
caauuuccaugacagucccguugguggucagcagcagauagugaacguggagguug

SEQ ID NO: 448 - RNA, 65 nt, Human herpesvirus 4
cuggcggguggagauagggaccagaggacuaauguucucuaacugugucccacuccaccugccgg

SEQ ID NO: 449 - RNA, 75 nt, Human herpesvirus 4
ggcggcggcggcccagacagaggagaggcggaggcacacacguaccccccuuaucucucggcggcugccgccgcc

SEQ ID NO: 450 - RNA, 142 nt, Human herpesvirus 4
uggugcauuugcaggugugaaaugcuuggccuugaguuacucuaaggcuaguccgauccccggguuuucacaaaaaaagccuauggauuggaccaaccuuaaaguaccaacaaggucacugcuuuuaguguaaaugaugcua

SEQ ID NO: 451 - RNA, 75 nt, Human herpesvirus 4
ggacuccuccccauucuccuucuccuccucagacuuuuccgaccaggacgagggagagggaggggaggcagaucu

SEQ ID NO: 452 - RNA, 69 nt, Human herpesvirus 4
ccugugggcccccugguggagaauauaaagagcaccuaucugaauaaaaucaccacggugguccacggg

SEQ ID NO: 453 - RNA, 62 nt, Human herpesvirus 4
ucugguuguugccguugacccccguguacuuguugauggucacuggcagcgugacaaccgga

SEQ ID NO: 454 - RNA, 73 nt, Human herpesvirus 4
ggcgguggcggccaagcgccugggggaugucaucucagucucccagugcgugcccguuaaccaggccaccguc

SEQ ID NO: 455 - RNA, 57 nt, Human herpesvirus 4
cugacggccccuccgugccccuacgccgaaaguucaugggcacaggcggccgugcag

SEQ ID NO: 456 - RNA, 83 nt, Human herpesvirus 4
gaggagggccuggccggccuugggcucgaugacaaaucugacugugagucugaggaugagucuaauuuccgcaggcccucuuc

SEQ ID NO: 457 - RNA, 95 nt, Human herpesvirus 4
gacagcagcggcgguagcggaggggcagacgcccagccaccccuggcagagguggacggggggcucgcccgcgugacgcgucaguugcugcuguc

SEQ ID NO: 458 - RNA, 154 nt, Human herpesvirus 4
ggcccugggguaagucugggaggcagagggucggccuaggcccggggaaguggagggggaucgcccgggucucuguuggcagaguccgggcgauccucugagacccuccgggcccggacggucgcccucagccccccagacagaccccaggguc

SEQ ID NO: 459 - RNA, 61 nt, Human herpesvirus 4
agugggggucaaacaaguagaaggagccaucugucucgaugaugauggcccccgcguagau

SEQ ID NO: 460 - RNA, 56 nt, Human herpesvirus 4
ccccgggugggauccauggcuggauuuccaggaaaggaggccggcccgcccggcgg

SEQ ID NO: 461 - RNA, 126 nt, Human herpesvirus 4
gucgucauccucaacaauuauaggaucaucuggcagucuaggagccucaauauucauggccugcccgcgggcauaggccagaucaaucuccucguuuguuaacggaucaucauaaggaauggcgac

SEQ ID NO: 462 - RNA, 55 nt, Human herpesvirus 4
gggguccaggagucugcugcggcuaugcagcccauaccuauagauccugggcccc

SEQ ID NO: 463 - RNA, 55 nt, Human herpesvirus 4
uggucuuugcaggacuauaccuggcggcagggaaugagucggaugugaaagaucg

SEQ ID NO: 464 - RNA, 55 nt, Human herpesvirus 4
gugucaccggugaugcgccugacguugugccggcugguguugggcuggugacauc

SEQ ID NO: 465 - RNA, 56 nt, Human herpesvirus 4
gcugcugcuugucgaggaugguccuuuggcgcggauccucgcaggccgccagcagc

SEQ ID NO: 466 - RNA, 56 nt, Human herpesvirus 4
gauuuccuggcuccgugacaagguggcggccgccgucacccugccggagaagauuc

SEQ ID NO: 467 - RNA, 66 nt, Human herpesvirus 4
ucccucaguguuugccagcuuauuuccccaguuuucacguacuggggccuguggacaccugaggga

SEQ ID NO: 468 - RNA, 93 nt, Human herpesvirus 4
accaagggccaccuggauccaggagcuguuucgcacugcgguggagguagagacugccuucaucgaggcucguggagaggggguuaccuuggu

SEQ ID NO: 469 - RNA, 61 nt, Human herpesvirus 4
cuaaggggacaccaggcauacaaggacuggguaauaaccuuguaugccugcguccucuuag

SEQ ID NO: 470 - RNA, 72 nt, Human herpesvirus 4
gugggaccuuagagguggagcaacgucuaaagugguaauaacaccaggcggggcugggcaaagggguccuac

SEQ ID NO: 471 - RNA, 113 nt, Human herpesvirus 4
ccugcgggcgagcaucgggucaucgggcauaucggccuugaccgcguugaacaugcuguaugccucgcagcgcggccgucugaccgagaaccuaagaaacgcccuucagcagg

SEQ ID NO: 472 - RNA, 67 nt, Human herpesvirus 4
ggauaagaaacacgcuggcuuuuugcuuaaaaaugugcagcuucuccagcgucauuucuuccaaucc

SEQ ID NO: 473 - RNA, 72 nt, Human herpesvirus 4
aguuguacucccggaagaugcccuccaggucaaagacguuggaggcacgcuguucgucccgugaguacagcu

SEQ ID NO: 474 - RNA, 59 nt, Human herpesvirus 4
uccaucagcucucuuuuccccgggcugguuuugcuggcccuggagcugaaguugaugga

SEQ ID NO: 475 - RNA, 55 nt, Human herpesvirus 4
cagcgcccggcacagaauuugcuggcuagaugccagugagcccccggguacgcug

SEQ ID NO: 476 - RNA, 56 nt, Human herpesvirus 4
cugaggccugggaucguuguuggugccacgcagcgccacuagcagcagguucucag

SEQ ID NO: 477 - RNA, 59 nt, Human herpesvirus 4
uggacgcagcuacuugaccuuugcccccgugccuccagcgcugauaagugcugcgucca

SEQ ID NO: 478 - RNA, 56 nt, Human herpesvirus 4
ggggccuggguaguagcgggcaacgagagacucugugcaaucaaaccccaggcucc

SEQ ID NO: 479 - RNA, 62 nt, Human herpesvirus 4
accuauagguuauuaaccuagugguggaauaggguauugcagcuggguauauaccuauaggu

SEQ ID NO: 480 - RNA, 57 nt, Human herpesvirus 4
guagcaggcaugucuucauuccugcguaccgaauggcaugaaggcacagccuguuac

SEQ ID NO: 481 - RNA, 56 nt, Human herpesvirus 4
gagcggggcagcggacccagcggacccggugggccacccggccgccccccgagcuc

SEQ ID NO: 482 - RNA, 56 nt, Human herpesvirus 4; identical to SEQ ID NO: 481

SEQ ID NO: 483 - RNA, 56 nt, Human herpesvirus 4; identical to SEQ ID NO: 481

SEQ ID NO: 484 - RNA, 56 nt, Human herpesvirus 4; identical to SEQ ID NO: 481

SEQ ID NO: 485 - RNA, 56 nt, Human herpesvirus 4; identical to SEQ ID NO: 481

SEQ ID NO: 486 - RNA, 56 nt, Human herpesvirus 4; identical to SEQ ID NO: 481

SEQ ID NO: 487 - RNA, 56 nt, Human herpesvirus 4; identical to SEQ ID NO: 481

SEQ ID NO: 488 - RNA, 56 nt, Human herpesvirus 4; identical to SEQ ID NO: 481

SEQ ID NO: 489 - RNA, 56 nt, Human herpesvirus 4; identical to SEQ ID NO: 481

SEQ ID NO: 490 - RNA, 56 nt, Human herpesvirus 4; identical to SEQ ID NO: 481

SEQ ID NO: 491 - RNA, 56 nt, Human herpesvirus 4; identical to SEQ ID NO: 481

SEQ ID NO: 492 - RNA, 56 nt, Human herpesvirus 4; identical to SEQ ID NO: 481

SEQ ID NO: 493 - RNA, 56 nt, Human herpesvirus 4; identical to SEQ ID NO: 481

SEQ ID NO: 494 - RNA, 119 nt, Human herpesvirus 4
cuuuguguuagguuaguaugggcuggguauucacuagugaaggcaacuaacacaguuagacgugcuaguugugcccacugguguuuauccggucccaaaugucaccacagaacacaggg

SEQ ID NO: 495 - RNA, 61 nt, Human herpesvirus 4
agcauucccaagcaaacaaaacauguuuaaauuaacccaugucauguuugcggggaauguu

SEQ ID NO: 496 - RNA, 55 nt, Human herpesvirus 4
gccggcugcagccggguccgggguuccggcccuggagcucggggggcggccgggu

SEQ ID NO: 497 - RNA, 55 nt, Human herpesvirus 4; identical to SEQ ID NO: 496

SEQ ID NO: 498 - RNA, 55 nt, Human herpesvirus 4; identical to SEQ ID NO: 496

SEQ ID NO: 499 - RNA, 55 nt, Human herpesvirus 4; identical to SEQ ID NO: 496

SEQ ID NO: 500 - RNA, 60 nt, Human herpesvirus 4
uaggcauagagagugaugagcccgcuucgacagagccgguucaugaucagcuacugccug

SEQ ID NO: 501 - RNA, 76 nt, Human herpesvirus 4
gcaucuccaauaaguagauccagauaccuaagacugcguugaaaaaagaguguuaggguuggaaaagugggggugu

SEQ ID NO: 502 - RNA, 80 nt, Human herpesvirus 4
acgcguccuccgcugacccuguccgugugccugaccaagugcuccuugcuucccacgguggggugugacaggaugcuugu

SEQ ID NO: 503 - RNA, 60 nt, Human herpesvirus 4
uuauuuucuccaaaucgcuccuugcaacaauggacacgcaagggcgaaugcagaaaauag

SEQ ID NO: 504 - RNA, 65 nt, Human herpesvirus 4
ggacgccuucaagugcaucgaagagcaggugaacaagaccaugcaugagaaguacgaggccgucc

SEQ ID NO: 505 - RNA, 150 nt, Human herpesvirus 4
cccuggggucugucuggggggcugagggcgaccguccgggcccggagggucucagaggaucgcccggacucugccaacagagacccgggcgaucccccuccacuuccccgggccuaggccgacccucugccucccagacuuaccccaggg

SEQ ID NO: 506 - RNA, 88 nt, Human herpesvirus 4
cugcgaucuggaggacaaauuacacacacuugcgccugagcgccaagcacaggguuguugguccucauauucacgaggucgcugagag

SEQ ID NO: 507 - RNA, 55 nt, Human herpesvirus 4
ccagcgugaggucuuauuuuugaaaagggauauuauaaaacaggucauugcucgg

SEQ ID NO: 508 - RNA, 55 nt, Human herpesvirus 4
ggggcuggcgaggcggcguccgcgggccgaggggauguggcccugagucaguccc

SEQ ID NO: 509 - RNA, 56 nt, Human herpesvirus 4
uuaaguucgggggucaggggggaguccagauucaaauccucugucauggacucuag

SEQ ID NO: 510 - RNA, 56 nt, Human herpesvirus 4
uggguccgcugggccgcugccccgcuccgggugggggguggccccgcugggcaccg

SEQ ID NO: 511 - RNA, 82 nt, Human herpesvirus 4
gauggcggcuggagagaaggaugcccggcuccccgccgccuccugcacacgagcggccagggccuccaucucugccgccauc

SEQ ID NO: 512 - RNA, 64 nt, Human herpesvirus 4
ggcggagccucaggaggguccccuccauaggguugaaccaggagggggaggauugggcuccgcc

SEQ ID NO: 513 - RNA, 59 nt, Human herpesvirus 4
cggucuacauacacgcgcgucagcccaucuuuugucaucuugaccgcguuguagcacug

SEQ ID NO: 514 - RNA, 81 nt, Human herpesvirus 4
ccuggcuucugaccggggugcugccggccggcgcuuccagucccacaaacgcggcggcggcuucccugacugaagcccagg

SEQ ID NO: 515 - RNA, 92 nt, Human herpesvirus 4
guggucauguuucccuccaagcggcacagauuagaagaugaugcauaaaauuuuauucuacaucaugccugguucgguggggucgugacuau

SEQ ID NO: 516 - RNA, 56 nt, Human herpesvirus 4
ggccccccagcccccccgcacagagcggcgcuacggcgggcgggcggcgggggguc

SEQ ID NO: 517 - RNA, 79 nt, Human herpesvirus 4
ggagggggaccugaccugcaugcucuccaggccaucagagaaggccacuacagcauccagguccuggcggaucuccucc

SEQ ID NO: 518 - RNA, 56 nt, Human herpesvirus 4
ccuuguugaauaggccaucuugcucuacaagaucuggcacaaauguaauuaagagg

SEQ ID NO: 519 - RNA, 114 nt, Human herpesvirus 4
gggggugcacaccucccagccggcccggcguccuugcggcggccuccccccccaugaagcggguggcgcggggucccugccuggcaccaggguccggccugggagcgcaccccc

SEQ ID NO: 520 - RNA, 58 nt, Human herpesvirus 4
guagucggacacgugcauggaccgguuaauccgaucuggucgcaggcacucguacugc

SEQ ID NO: 521 - RNA, 86 nt, Human herpesvirus 4
uugggcaccucgauaaccggcucguggcucguacagacgauuguuuggcucuguaacuugccagggacggcugacgauguguuuag

SEQ ID NO: 522 - RNA, 56 nt, Human herpesvirus 4
gcggccgccagggcccgggucucugcgaugagccgagagccguccagcggaucguc

SEQ ID NO: 523 - RNA, 56 nt, Human herpesvirus 4
uuuccccaggcagucccagcgccgaggcaagaguggggcuguggaugguguggaag

SEQ ID NO: 524 - RNA, 75 nt, Human herpesvirus 4
caccaugugccaacauagaggcauuccuggcacaccucaccagguguguguaugcccuguacuuggacgugcgug

SEQ ID NO: 525 - RNA, 156 nt, Human herpesvirus 4
gcgugucuggggccgccugagcccauccucgcccacaucgcucucccuggcuuuucccuaugcgggcccgccccccguggcgugguaccgacauucuaucaaccuaacaaggagugaagguguggggaucggcaaagauugcgcccaggaucacgc

SEQ ID NO: 526 - RNA, 56 nt, Human herpesvirus 4
gcucuuguguccaggcaucccugcgcugaggugguggggguggugggggcgggggu

SEQ ID NO: 527 - RNA, 56 nt, Human herpesvirus 4
ucugggaggaaguuuuaacaccugaccagcguguuucauuuauggaauuccuagga

SEQ ID NO: 528 - RNA, 56 nt, Human herpesvirus 4
cgggcgcagccaugcgugaccgugaugagggggcagggucgcagggggugugucug

SEQ ID NO: 529 - RNA, 56 nt, Human herpesvirus 4; identical to SEQ ID NO: 528

SEQ ID NO: 530 - RNA, 56 nt, Human herpesvirus 4; identical to SEQ ID NO: 528

SEQ ID NO: 531 - RNA, 58 nt, Human herpesvirus 4
uauuuucugcauucgcccuugcguguccauuguugcaaggagcgauuuggagaaaaua

SEQ ID NO: 532 - RNA, 66 nt, Human herpesvirus 4
ucccucagguguccacaggccccaguacgugaaaacuggggaaauaagcuggcaaacacugaggga

SEQ ID NO: 533 - RNA, 65 nt, Human herpesvirus 4
ugaggcuagagauccaggcucguggggcauuuagacaguaguagcagagcagggcauaguccuca

SEQ ID NO: 534 - RNA, 66 nt, Human herpesvirus 4
ccgccgccgcguuugugggacuggaagcgccggccggcagcaccccggucagaagccagguggcgg

SEQ ID NO: 535 - RNA, 62 nt, Human herpesvirus 4
ucucuaaugcguagcagccacucucuaagagacuacauuggaagguggcuggugauuggagg

SEQ ID NO: 536 - RNA, 55 nt, Human herpesvirus 4
cuccauaggcgacguggacgggggaauaaucaaccuguauaaugacuaugaggag

SEQ ID NO: 537 - RNA, 55 nt, Human herpesvirus 4
cguggucaugugcagcuugcauacgacgcccguguccugacgccugacuuucacg

SEQ ID NO: 538 - RNA, 66 nt, Human herpesvirus 4
ugcguggcuggacggaggacgauagcccaggcacaucuggcaccuguccuugucugcugccaugca

SEQ ID NO: 539 - RNA, 56 nt, Human herpesvirus 4
ggggguucuugcuaaugggaaagaggucccauguacagcacaaccuuggacccugc

SEQ ID NO: 540 - RNA, 162 nt, Human herpesvirus 4
acccagacuagcccccagguuccugugaaaagcaagaagcauguauacuaagccucccuuuaugugagcccuggagaggucagguuacuuaccccugaaggugaaccgcuuaccaccuccucuucuugcuggacgaggacccuucuacggacucgucugggu

SEQ ID NO: 541 - RNA, 131 nt, Human herpesvirus 4
gccgcaaauaucagaauuagcaucagaaaagugagccccacaaacaccaguguccagagaggaagaccguaagauaaagauggcugccucucaucuggaacggugggaagcucagcaguuguuuuuguggc

SEQ ID NO: 542 - RNA, 58 nt, Human herpesvirus 4
cagggccauguguuccugcaugucuacuugccuccugugguggcagagcuuggcccug

SEQ ID NO: 543 - RNA, 58 nt, Human herpesvirus 4
ucugcccguuuacugauagaauguuagcuuggauuagcuguuaguauucugaggcaga

SEQ ID NO: 544 - RNA, 58 nt, Human herpesvirus 4
cuugucauuuuucccaacgcaggucacuggcaggugccagggcuugggaagugacagg

SEQ ID NO: 545 - RNA, 71 nt, Human herpesvirus 4
cgugcuguuuuuggccauccucaagcucugguccauacaggucuucauccagguccuuuccuacaagcacg

SEQ ID NO: 546 - RNA, 67 nt, Human herpesvirus 4
gucgcucaacuccacguucaucccccaguuuacggaggugaccaucgaguaccuuccgaggagcgac

SEQ ID NO: 547 - RNA, 63 nt, Human herpesvirus 4
ugcuggaaguuaaccgccauaacgccaucugcguggccaccaacgucccugaguucuacaaug

SEQ ID NO: 548 - RNA, 59 nt, Human herpesvirus 4
uccaucaacuucagcuccagggccagcaaaaccagcccggggaaaagagagcugaugga

SEQ ID NO: 549 - RNA, 55 nt, Human herpesvirus 4
cuaaacaaggaggaagaugccaacucgggcuucacauuuaaccuguuuuaucaag

SEQ ID NO: 550 - RNA, 61 nt, Human herpesvirus 4
uaggcggacgaguggcuucggaaaagcgagccuggcguagaggccacagccgccucagaag

SEQ ID NO: 551 - RNA, 56 nt, Human herpesvirus 4
aauacaaauaaauuucucuuaccugcgucuguuuguguagugagguguuguguccu

SEQ ID NO: 552 - RNA, 56 nt, Human herpesvirus 4
ccacgggcaaaacuugcgucaauggccuucugcagaagcuauucuuuuucccgugg

SEQ ID NO: 553 - RNA, 55 nt, Human herpesvirus 4
gcugccccugaccaguuaggacccuugacggaugucuuuaacggcgcggugcagu

SEQ ID NO: 554 - RNA, 55 nt, Human herpesvirus 4
agcggcacagauuagaagaugaugcauaaaauuuuauucuacaucaugccugguu

SEQ ID NO: 555 - RNA, 59 nt, Human herpesvirus 4
uugaguccaaacagcuaauuucuaccuaucagaggguggucaccgcgaccaagacucaa

SEQ ID NO: 556 - RNA, 56 nt, Human herpesvirus 4
auuggugcagguugggaggaaaacguaguaaaagaucuuuuccagcacauccgcau

SEQ ID NO: 557 - RNA, 88 nt, Human herpesvirus 4
ucccucuccccuggccucuccuucccgccucccacccgagcccccucagcuugccuccccaccggguccaucaggccggccggaggga

SEQ ID NO: 558 - RNA, 55 nt, Human herpesvirus 4
augccacccccccaaugccacacuaaaacaaggugaaauaggcaagugcguuuau

SEQ ID NO: 559 - RNA, 55 nt, Human herpesvirus 4
gcugcugcccgaagggaggugauggggauaucuccguuccagcccugucagcggc

SEQ ID NO: 560 - RNA, 76 nt, Human herpesvirus 4
cccgggccguggaaugagggccugagucucuuuaagcugcacaaggagcugaagcgcgccccauccgaagcccggg

SEQ ID NO: 561 - RNA, 56 nt, Human herpesvirus 4
ggaagugcgaacuugagccaggacacccgucuuucaacggcaacaauaccacuucc

SEQ ID NO: 562 - RNA, 85 nt, Human herpesvirus 4
cuggagucugagaauaaggcucugaagcaacagguccucagagggggugccugugccucgucuaccucuguuccuucugcuccag

SEQ ID NO: 563 - RNA, 55 nt, Human herpesvirus 4
gcuaguacugcagugggccucucuggcugugcugacccuucugcugcugcugguc

SEQ ID NO: 564 - RNA, 56 nt, Human herpesvirus 4
gcuucuucuugggcuucagcacaaugaggguaacauucauguagguuuuaggaggu

SEQ ID NO: 565 - RNA, 55 nt, Human herpesvirus 4
aacgcccggguccuugcuaccugugugguguguuaagggcuggguaaaggugucu

SEQ ID NO: 566 - RNA, 61 nt, Human herpesvirus 4
uccgggcggccuccuuuuccaggcgcagcuucggccucggccaucuggaggcggcccugga

SEQ ID NO: 567 - RNA, 169 nt, Human herpesvirus 4
uuucagggggaucuuuacguggguggauguagggagcacucggggcccuuuuugguuuggcacgaagccuucuccuggacccuggaccaacuagcggcgagacccgaggcagacaaggccccgccaucccacgaccaccuguugacccugguccgcgaccugacccgga

SEQ ID NO: 568 - RNA, 56 nt, Human herpesvirus 4
ugcgccugagcucccgcucccaucgcaaaaaguugaguucgguagucgagggcgcg

SEQ ID NO: 569 - RNA, 62 nt, Human herpesvirus 4
ggacgcagccccggaggccacgcagcaugacagagcugguggucgccgggaugcuaauguuc

SEQ ID NO: 570 - RNA, 56 nt, Human herpesvirus 4
gguggcaugcaaaauaacugacugccugggcaaguuccucuuuugcugcagacacc

SEQ ID NO: 571 - RNA, 56 nt, Human herpesvirus 4
cggggggucacgcgcaggcuuacuuuuugcauggucaggcuccguguccccccggg

SEQ ID NO: 572 - RNA, 65 nt, Human herpesvirus 4
gcgcgcauaauggcggaccuaggccuaaaacccccaggaagcgggucuaugguuggcugcgcugc

SEQ ID NO: 573 - RNA, 101 nt, Human herpesvirus 4
cugaugcucuguggcaccucaaggugaauauagcugcccaucgacguaucgcuggaaaccggugggccgcuguucaccuaaagugacgcaaggucugucag

SEQ ID NO: 574 - RNA, 86 nt, Human herpesvirus 4
uccaguguccugauccuggaccuugacuaugaaacaauucuaaaaaaaugcaucauaguccaguguccagggacagugcacucgga

SEQ ID NO: 575 - RNA, 76 nt, Human herpesvirus 4
agcaccaucagcccggggggacacggagccugaccaugcaaaaaguaagccugcgcgugaccccccgccuggugcu

SEQ ID NO: 576 - RNA, 63 nt, Human herpesvirus 4
ccuccccucccucucccucguccuggucggaaaagucugaggaggagaaggagaauggggagg

SEQ ID NO: 577 - RNA, 90 nt, Human herpesvirus 4
gauguggugccuggcaaccuggucacuuacgccaagcagaggcucaacaacgccauccugaaggcgugcggccagacccaguucuacauc

SEQ ID NO: 578 - RNA, 98 nt, Human herpesvirus 4
ggggcguugguggcggagucuggcaacgcccggguccuugcuaccugugugguguguuaagggcuggguaaaggugucugccaauucucgcauguccu

SEQ ID NO: 579 - RNA, 56 nt, Human herpesvirus 4
agggccauguguuccugcaugucuacuugccuccugugguggcagagcuuggcccu

SEQ ID NO: 580 - RNA, 55 nt, Human herpesvirus 4
gcuucuuuucgcacgguguauguuuggggacccgcaugccgguacugggauaggc

SEQ ID NO: 581 - RNA, 57 nt, Human herpesvirus 4
caccgauuucuaggcagcauccucuuuaauagguacaaggggggugcgguguuggug

SEQ ID NO: 582 - RNA, 84 nt, Human herpesvirus 4
cuucaguuugugcuuguggaccucucagaguuucaggacgauuuaccuggaugcuggacggagauuuacaugcaggcauugaag

SEQ ID NO: 583 - RNA, 56 nt, Human herpesvirus 4
gccgccagguccuggggcagccgggguuccuggcgcuccgggggcagccgggcggc

SEQ ID NO: 584 - RNA, 64 nt, Human herpesvirus 4
gguggaacagaugcuguugaggcaaaagacuauguucucuacgguguuuuuggcuugcuccacc

SEQ ID NO: 585 - RNA, 81 nt, Human herpesvirus 4
cugcggagggcugggcugcgccucucuggaagccacgugugucuccuggacaaggacggagcgcgcccggcccccugccag

SEQ ID NO: 586 - RNA, 77 nt, Human herpesvirus 4
cgaggcauggaagggaagacacgucggcugagguuuuagcaugccagaugaaauuuaccaccccuuucagagucuug

SEQ ID NO: 587 - RNA, 55 nt, Human herpesvirus 4
agcaccauggggaaaacaauguccacaucauuggacucuaacuucacgguggcau

SEQ ID NO: 588 - RNA, 72 nt, Human herpesvirus 4
cugcugacccgcugcgucauauuuauguggcggcucuugaacccaaaggcgcuauagacgguugggcaguag

SEQ ID NO: 589 - RNA, 55 nt, Human herpesvirus 4
gacugaaggcaucucuuaggucccucaacauuuggggaaaauugucacauugguc

SEQ ID NO: 590 - RNA, 99 nt, Human herpesvirus 4
agguuuaucaauugugggauauggauagaggguggugaucuugguguaauuaaacaagagcacacacccacucuaucuaaauuccacaccugaaagccu

SEQ ID NO: 591 - RNA, 63 nt, Human herpesvirus 4
aauuucaagagcugaaccagaauaaucuccccaaugauguuuuucgggaggcucaaagaaguu

SEQ ID NO: 592 - RNA, 56 nt, Human herpesvirus 4
uuugagaauuccaaguacaucaaaacacaccuguuuacccagacccugagcucgga

SEQ ID NO: 593 - RNA, 55 nt, Human herpesvirus 4
gucuguaccguagacugccguggugccgcgccgacgacccagggcacagauagac

SEQ ID NO: 594 - RNA, 71 nt, Human herpesvirus 4
gucacaacuacuagaccaugacuuuguaaccgagugguacugguucaacuccagggucuagcaccugugac

SEQ ID NO: 595 - RNA, 103 nt, Human herpesvirus 4
gaggcaaguagccuccggugacaccuggugacuaguggugcgcuggacacuuauuuacagcacaacacuaacacuagguuccaccaaagguuaacaaugccuu

SEQ ID NO: 596 - RNA, 73 nt, Human herpesvirus 4
ggguccagggggcagccgcggcccagcgcgccccguucacgggggaggaccgcggccgagccaccaggggccc

SEQ ID NO: 597 - RNA, 56 nt, Human herpesvirus 4
gagggcagacggaugucaggucgggcccggacccggcccggagacugguggcccuc

SEQ ID NO: 598 - RNA, 69 nt, Human herpesvirus 4
guggaaauguccccuuucuaugacgggaaaaauaaggaaaccuuccaugagcgggcagacuccuuccac

SEQ ID NO: 599 - RNA, 55 nt, Human herpesvirus 4
agguagauaaccuuuugcucaaggagucucugcuagaggacuuuaagggcuaccu

SEQ ID NO: 600 - RNA, 75 nt, Human herpesvirus 4
gcugcaccgggcugucgaaggucaccguuccggcaaagauggccggggggaagagcacaugcagccugaugcggc

SEQ ID NO: 601 - RNA, 55 nt, Human herpesvirus 4
gcgggcccaggccaugcacauguccuccucuggguagacgguggccugaguccgc

SEQ ID NO: 602 - RNA, 56 nt, Human herpesvirus 4
cugccucagaauacuaacagcuaauccaagcuaacauucuaucaguaaacgggcag

SEQ ID NO: 603 - RNA, 62 nt, Human herpesvirus 4
cccuggccacuauucucuucuuuaaacgccucaagaaagaugcagugauucaggagguucag

SEQ ID NO: 604 - RNA, 66 nt, Human herpesvirus 4
ccgucaccccccgcaggaccaccggccgcaugcaagugcggucgggucccaagcaggggaugaugg

SEQ ID NO: 605 - RNA, 65 nt, Human herpesvirus 4
gacacgccgcucguggaccacgccaucuuccucccggcugauuguguggcugacggugccguguu

SEQ ID NO: 606 - RNA, 66 nt, Human herpesvirus 4
ggccugcagcugagacuccauggagcggaucuucuuuagauagagcucccucuccuucucuaggcc

SEQ ID NO: 607 - RNA, 63 nt, Human herpesvirus 4
gaacuccagcggcgggaccuggccaaauacuggccgguacucuccgacauugccgccgaguuc

SEQ ID NO: 608 - RNA, 55 nt, Human herpesvirus 4
cagcagcagcagaagggucagcacagccagagaggcccacugcaguacuagcaug

SEQ ID NO: 609 - RNA, 58 nt, Human herpesvirus 4
gagagccagugggggggguguuuauugucaccgacaacguucugcgccagcucuugac

SEQ ID NO: 610 - RNA, 57 nt, Human herpesvirus 4
ugaguccaaacagcuaauuucuaccuaucagaggguggucaccgcgaccaagacuca

SEQ ID NO: 611 - RNA, 55 nt, Human herpesvirus 4
gcguggcacagcagcccgggguagguccccuggaccugccgcuggcggacuacgc

SEQ ID NO: 612 - RNA, 56 nt, Human herpesvirus 4
gguugucacgcugccagugaccaucaacaaguacacgggggucaacggcaacaacc

SEQ ID NO: 613 - RNA, 56 nt, Human herpesvirus 4
gagccucaggaggguccccuccauaggguugaaccaggagggggaggaucgggcuc

SEQ ID NO: 614 - RNA, 71 nt, Human herpesvirus 4
gagagcccaggggucucgugcagguguccccggggaauuguucucccugaucaccgcccacccccguuuuc

SEQ ID NO: 615 - RNA, 55 nt, Human herpesvirus 4
ccccgcccaugucagagucagcaccuaugcgcacgacauccugcaguacgugggg

SEQ ID NO: 616 - RNA, 65 nt, Human herpesvirus 4
ggaccucccuggugccugaagacccacucccuuggaugugggcccucuucuacggccccaggucc

SEQ ID NO: 617 - RNA, 77 nt, Human herpesvirus 4
acauguccuguuagcuggugcgguuauaacugccagagcuguguuucccgacgccaaugcuaacuccccaaacaugu

SEQ ID NO: 618 - RNA, 56 nt, Human herpesvirus 4
ugccggcuacccggagaguuuccaguauuagaugucacggcagccuggguccggca

SEQ ID NO: 619 - RNA, 58 nt, Human herpesvirus 4
ugaguagagcuggguagaccugucguuguauugggaucagcaaauccaguuguauuca

SEQ ID NO: 620 - RNA, 72 nt, Human herpesvirus 4
uggugggaccugaugcugcuggugugcuguaaauaagugccuagcacaucacguaggcaccaggugucacca

SEQ ID NO: 621 - RNA, 61 nt, Human herpesvirus 4
gcacacgcccccauuucuaaagucauacgcccguauucacacauucccggggaaggugugu

SEQ ID NO: 622 - RNA, 66 nt, Human herpesvirus 4
gguaucgacggcugcggcggcggaggcggcggcagucgcccccgaagucgcggcccggaggcugcu

SEQ ID NO: 623 - RNA, 55 nt, Human herpesvirus 4
ugucauggugaggcaggcaaggcgagcaacgggggcuuaguggcucaaagugaug

SEQ ID NO: 624 - RNA, 67 nt, Human herpesvirus 4
guccucggggcagggguggcuaggccuggucuccguagaagagccgggcaggccgcaggcagaggac

SEQ ID NO: 625 - RNA, 76 nt, Human herpesvirus 4
gggcgugggaggcuggacuuuacagacagugcacaggagacugggccucaggcuggggggagaaaagcuggcgccc

SEQ ID NO: 626 - RNA, 76 nt, Human herpesvirus 4; identical to SEQ ID NO: 625

SEQ ID NO: 627 - RNA, 76 nt, Human herpesvirus 4; identical to SEQ ID NO: 625

SEQ ID NO: 628 - RNA, 76 nt, Human herpesvirus 4; identical to SEQ ID NO: 625

SEQ ID NO: 629 - RNA, 76 nt, Human herpesvirus 4; identical to SEQ ID NO: 625

SEQ ID NO: 630 - RNA, 76 nt, Human herpesvirus 4; identical to SEQ ID NO: 625

SEQ ID NO: 631 - RNA, 76 nt, Human herpesvirus 4; identical to SEQ ID NO: 625

SEQ ID NO: 632 - RNA, 56 nt, Human herpesvirus 4
gcgaccggugccuucuuaggagcuguccgaggggacccugagacgggugggugugu

SEQ ID NO: 633 - RNA, 66 nt, Human herpesvirus 4
acacccgugcuugucuugcagccacguggccacgugacacacacuguugggaugggagagggugau

SEQ ID NO: 634 - RNA, 55 nt, Human herpesvirus 4
uggcgaguuugcguccucagaagugaccauuggcacugaauagguagcauuguca

SEQ ID NO: 635 - RNA, 56 nt, Human herpesvirus 4
gccaggugggcccuggccacggccgacacggccacccucagaaggcgccuccuggu

SEQ ID NO: 636 - RNA, 71 nt, Human herpesvirus 4
ccugauugcugagaaccugcugcuaguggcgcugcguggcaccaacaacgaucccaggccucagcgucagg

SEQ ID NO: 637 - RNA, 67 nt, Human herpesvirus 4
ugcagcuucaccugcccaagaagcggcugaccucacagagccgcugcggccugguucugacgcugca

SEQ ID NO: 638 - RNA, 55 nt, Human herpesvirus 4
gucagguggccgugcuaugcgccccgggcaccaggggccaugaaagccuccuggc

SEQ ID NO: 639 - RNA, 164 nt, Human herpesvirus 4
uuggcauagacuaaacacaggcguccgcaccagcccccuuaccagauggagugcaccacagccaacuccaugguuauguacaauaacaaaauauguacagaaccaaagagguggccccgggacacuccucugggguuccaaugcgccgccugucugcuugccaa

SEQ ID NO: 640 - RNA, 56 nt, Human herpesvirus 4
agaugcucuugccuagauacaggaugucguccaugcugaggggagguggggugucu

SEQ ID NO: 641 - RNA, 56 nt, Human herpesvirus 4
cuagaauaaacugagaacagucaucaguaaaucugucucucgcgugauuuccauag

SEQ ID NO: 642 - RNA, 55 nt, Human herpesvirus 4
ccaucuuccccgaggucagaaagaggcucugcaugaggucccgggcuucggaugg

SEQ ID NO: 643 - RNA, 96 nt, Human herpesvirus 4
gggcgcucucgguggugucugcaugguggcgggugcccacuggcgcaacagcaugguagcaggacccguugguguaggcugauauggaaugugccc

SEQ ID NO: 644 - RNA, 59 nt, Human herpesvirus 4
gcaggguccaagguugugcuguacaugggaccucuuucccauuagcaagaacccccugc

SEQ ID NO: 645 - RNA, 75 nt, Human herpesvirus 4
guuguuuguacuggacccugaauuggaaacaguaacuuggauucuguaacacuucaugggucccguagugacaac

SEQ ID NO: 646 - RNA, 59 nt, Human herpesvirus 4
ugucauugauuacuucaccuuucagcacaaacaccugaaggugaccaacauugaugaca

SEQ ID NO: 647 - RNA, 60 nt, Human herpesvirus 4
gcagcguguuuugggucuugaugaggaacacgauccugucuaggauuuugauguuguugc

SEQ ID NO: 648 - RNA, 61 nt, Human herpesvirus 4
cuaagaggacgcaggcauacaagguuauuacccaguccuuguaugccugguguccccuuag

SEQ ID NO: 649 - RNA, 70 nt, Human herpesvirus 4
cacugauuacgguuuccuagauuguacagaugaacuagaacugucacaaucuauggggucguagacagug

SEQ ID NO: 650 - RNA, 55 nt, Human herpesvirus 4
cccgcaguuguagacugucauuuuuaugggcgagugggcgguccacacgcgcggg

SEQ ID NO: 651 - RNA, 56 nt, Human herpesvirus 4
ugggcacugugucacccuugccuaauauccuacuggcucaguuccccgcaggccca

SEQ ID NO: 652 - RNA, 63 nt, Human herpesvirus 4
ccacgagccgcuucgcccguguggcccgggcggccuaccugcgggcggaggccgaggccgugg

SEQ ID NO: 653 - RNA, 65 nt, Human herpesvirus 4
gccgcacucgaggcccugaugcucgucuacacgcucugcgagaccgccaaccuggccgaggcggc

SEQ ID NO: 654 - RNA, 56 nt, Human herpesvirus 4
gggguaguagguuuugggagggugccgugcuagauauuucaacugccacagacccc

SEQ ID NO: 655 - RNA, 85 nt, Human herpesvirus 4
guagcaaaagaccacggcuguuagaaugugcacggaaagcguuccagcuucguccaccacgaucacauuggugguccauagcugc

SEQ ID NO: 656 - RNA, 75 nt, Human herpesvirus 4
gggguaaaugcaccuugacuguaaucacuggcaaagggcaugcuugggcaugcuguaccugaugagucacacccc

SEQ ID NO: 657 - RNA, 108 nt, Human herpesvirus 4
gacgaaaccuugacccuucuugucaaccucuucaggcccgggguuagugaugaaacaggcaacuccggggcugaucagguuaauaaggagccguccuuauucuugcuc

SEQ ID NO: 658 - RNA, 56 nt, Human herpesvirus 4
caugaaccugggaccuauugaugcagaucucgcagugagaccccagagucaggcug

SEQ ID NO: 659 - RNA, 55 nt, Human herpesvirus 4
ccccgacaucgccgccccaggggucucuagaccucgaguccggggagaacggugg

SEQ ID NO: 660 - RNA, 62 nt, Human herpesvirus 4
cgaagacgaggagucugagcgucgagacgccccuccacccccgcucgauuccagcuuccaag

SEQ ID NO: 661 - RNA, 55 nt, Human herpesvirus 4
ggaggagcccaugcagcacuagcgucccggcgcucgucguucaggaacagccucc

SEQ ID NO: 662 - RNA, 59 nt, Human herpesvirus 4
gcuccaggggccaggggauaccgcucauaucacuaagggcggugcccagguagaggagc

SEQ ID NO: 663 - RNA, 100 nt, Human herpesvirus 4
uggagaguuggacuuuugaaaauaagccacgucugccgugaccgguguuacgauaaucucacagguggccugcuggccguggcagaguccuggagcucca

SEQ ID NO: 664 - RNA, 87 nt, Human herpesvirus 4
ggggcauacuggggagacggcgggggagguuuccucaggcuuggcuaagugcaaggaucccaugcccccgcgguuuugcuuggcccc

SEQ ID NO: 665 - RNA, 55 nt, Human herpesvirus 4
gcuccauugcccgcuccccgccccccuugggggcuuggcuggcgcggccgggggc

SEQ ID NO: 666 - RNA, 56 nt, Human herpesvirus 4
ccugccgcggggccuccugccgcggggccuccugccgcggggccuccugccgcggg

SEQ ID NO: 667 - RNA, 55 nt, Human herpesvirus 4
gccgccgagagauaagggggguacgugugugccuccgccucuccucugucugggc

SEQ ID NO: 668 - RNA, 56 nt, Human herpesvirus 4
cuggacgcgcgaccugcuacucuucggaaacgccaacccaggagcgucgccucugg

SEQ ID NO: 669 - RNA, 105 nt, Human herpesvirus 4
cgcuacccuuaaguuugccaacgucagcucaagacucgaauuucagcguaaaaacagaaaugcucgguaaugagauagauauugaguguauuauggaggauggcg

SEQ ID NO: 670 - RNA, 56 nt, Human herpesvirus 4
uggaucaggccguuauugagacugugcaggauacugccuaugacacugccuaucca

SEQ ID NO: 671 - RNA, 133 nt, Human herpesvirus 4
guggucggcuggcaccaggccuggccaugucacgagacgcagccuccggguccgugcaccuggacauacagguggacagggccgaggagggcugggucugcgacguucugcuggagcccgggccgcccaccgc

SEQ ID NO: 672 - RNA, 56 nt, Human herpesvirus 4
gccuccgacuaccucccggagauguuugcagagcaccccggccugguguuugaggu

SEQ ID NO: 673 - RNA, 65 nt, Human herpesvirus 4
cugcccggagacaacaaauuuaacaucaccugcaguggauacgagagccauguucccagcggcgg

SEQ ID NO: 674 - RNA, 55 nt, Human herpesvirus 4
caggucacuaaagugcuucaggacccacgcaaggucuguaccguagacugccgug

SEQ ID NO: 675 - RNA, 87 nt, Human herpesvirus 4
ggggccaagcaaaaccgcgggggcaugggauccuugcacuuagccaagccugaggaaaccucccccgccgucuccccaguaugcccc

SEQ ID NO: 676 - RNA, 56 nt, Human herpesvirus 4
cuccccauucuccuucuccuccucagacuuuuccgaccaggacgagggagagggag

SEQ ID NO: 677 - RNA, 64 nt, Human herpesvirus 4
gacaucauuagauggggggacuuuuaagguuuaucaaauuuuuggcucucauuguacauauguc

SEQ ID NO: 678 - RNA, 105 nt, Human herpesvirus 4
guggccccuguuugccgacugugaggguccagaggcccguguggcugcguuacaccgauauaaugccagccuggccccccacguguccacgcagaucuuugccac

SEQ ID NO: 679 - RNA, 56 nt, Human herpesvirus 4
gcccgcggccauugggcccagauugagagaccaguccaggggcccgagguuggagc

SEQ ID NO: 680 - RNA, 97 nt, Human herpesvirus 4
uuugccucccuggagcuguacucacgggacgaacagcgugccuccaacgucuuugaccuggagggcaucuuccgggaguacaacuuccaggcgcaaa

SEQ ID NO: 681 - RNA, 68 nt, Human herpesvirus 4
ggcgccuccaaugaggccacuguaaaccccggccuugggguagccgacgguggcuaaccucagcgcgu

SEQ ID NO: 682 - RNA, 65 nt, Human herpesvirus 4
ggccucuccuucccgccucccacccgagcccccucagcuugccuccccaccggguccaucaggcc

SEQ ID NO: 683 - RNA, 65 nt, Human herpesvirus 4; identical to SEQ ID NO: 682

SEQ ID NO: 684 - RNA, 90 nt, Human herpesvirus 4
aauaccugguacaggguaugcauacagccugcgucugacaccacguccagugucacgauuucuuggcaauaacaguauccuguacguguu

SEQ ID NO: 685 - RNA, 56 nt, Human herpesvirus 4
cugccgguugccauuuuucaagcugcuaaaccacgaguggcagcaggccuaagaag

SEQ ID NO: 686 - RNA, 67 nt, Human herpesvirus 4
cacaggugcuagacccuggaguugaaccaguaccacucgguuacaaagucauggucuaguaguugug

SEQ ID NO: 687 - RNA, 141 nt, Human herpesvirus 4
accuuguggguuguugugguggcauugguagccguucgugugauaaugagugucuugggggccgugccaagacccgagacaguaaugucaaauguccgauugcucgcaaaugcaccagaaauauuuucacaacccgaaggu

SEQ ID NO: 688 - RNA, 68 nt, Human herpesvirus 4
uuccgguggccgggacuguuucguugggucaucuggagucugacuuggcugaaccaccggccauggag

SEQ ID NO: 689 - RNA, 55 nt, Human herpesvirus 4
gucaugaccuggccugugccuugucccguggacaaugucccuccagcgugguggc

SEQ ID NO: 690 - RNA, 55 nt, Human herpesvirus 4
gguuugcccaacucuuauucuucccguuaacaggaagaaugauggugggggaacc

SEQ ID NO: 691 - RNA, 55 nt, Human herpesvirus 4
guggggugguguagguaugggauguagacaaguuacgccuaaaggcgcaguccgc

SEQ ID NO: 692 - RNA, 102 nt, Human herpesvirus 4
ggggugugcagaugcaggucuccgggugggcaggcaguacgagaugucacguuguguugucuuuccucccaccccuguccuggcuguggcaaaugcgacccu

SEQ ID NO: 693 - RNA, 56 nt, Human herpesvirus 4
gggccgccuguguggucuccugugaaaacuacaaucaggagguugccgaggggcuc

SEQ ID NO: 694 - RNA, 55 nt, Human herpesvirus 4
ccuggggccguagaagagggcccacauccaagggagugggucuucaggcaccagg

SEQ ID NO: 695 - RNA, 56 nt, Human herpesvirus 4
ggggggcggcggcuccugguaucccugguauggagccuggggggccggcggcuccu

SEQ ID NO: 696 - RNA, 74 nt, Human herpesvirus 4
gcggcgaaaacgacgcuggggagauggcuggucaccguauacgcggagaccaaccgcuaccccugggcggcugc

SEQ ID NO: 697 - RNA, 57 nt, Human herpesvirus 4
gaugugauaacggggaaugugugacaugcuauggugccggggcccacgugaacaucc

SEQ ID NO: 698 - RNA, 56 nt, Human herpesvirus 4
cgcgggcgguggagucggcagcggccuacgcggaggccaccuccucccuuacugcg

SEQ ID NO: 699 - RNA, 62 nt, Human herpesvirus 4
gcggugcaugauggauggugaguaauaaauucuuaagauauucaugaucugacaguggccgc

SEQ ID NO: 700 - RNA, 71 nt, Human herpesvirus 4
cucgggcgacgcgguggaggcgcugaaggcggacugcgccgccgccuucacggcgcacccccaguaccggg

SEQ ID NO: 701 - RNA, 56 nt, Human herpesvirus 4
gguuggguacaaaguaguugugaaaguuggcauaaugcacaaagguuguaacaauc

SEQ ID NO: 702 - RNA, 56 nt, Human herpesvirus 4
agggaggcggcggccggaggugggcuucuugugggggcuaucuuugcccaaucccu

SEQ ID NO: 703 - RNA, 74 nt, Human herpesvirus 4
guguuugggcagcaggccuacuucuacgccagcgcgccucagggucuggacguggaguuugcaguccucagcgc

SEQ ID NO: 704 - RNA, 66 nt, Human herpesvirus 4
gcugcugcuacuggcuuucguccucuggcucucuucgccagggggccuagguacucuuggugcagc

SEQ ID NO: 705 - RNA, 84 nt, Human herpesvirus 4
cccgcuucgguucucucugacuaggcucugauuuuccagcccauggagaucuagagucgaguuccaguuugacacggccgcggg

SEQ ID NO: 706 - RNA, 56 nt, Human herpesvirus 4
gugugugaacagugauuucaguaaaaccuaagagauauuuggugucacuuccgcau

SEQ ID NO: 707 - RNA, 172 nt, Human herpesvirus 4
cugccuggagacccuggggucugucuggggggcugagggcgaccguccgggcccggagggucucagaggaucgcccggacucugccaacagagacccgggcgaucccccuccacuuccccgggccuaggccgacccucugccucccagacuuaccccagggccacccggcgg

SEQ ID NO: 708 - RNA, 88 nt, Human herpesvirus 4
gccgcuggaugagggagcgccaauuuguacauccuagcucuggccauagaguuagcccacccuugugucucccuuuggccuuugcggu

SEQ ID NO: 709 - RNA, 56 nt, Human herpesvirus 4
ccgcuucagcugggcagcaugcuuggauaacuuacuaaacucgcgcccaugggcgg

SEQ ID NO: 710 - RNA, 56 nt, Human herpesvirus 4
uaagcuacuaugacuaaccuuucuuuacuucuaggcauuaccaugucauaggcuug

SEQ ID NO: 711 - RNA, 61 nt, Human herpesvirus 4
gucuguagaggaagugguugcgcaugcgggccagcucccaguagaccacguccccccagac

SEQ ID NO: 712 - RNA, 55 nt, Human herpesvirus 4
cccgauauucuaccugugguaacuagaaaucugaaugccauugagucccuuuggg

SEQ ID NO: 713 - RNA, 57 nt, Human herpesvirus 4
gagcaucggcaagauuuugacaugcaggacagcauggucucaugccccugcuuucgc

SEQ ID NO: 714 - RNA, 70 nt, Human herpesvirus 4
cacugucuacgaccccauagauugugacaguucuaguucaucuguacaaucuaggaaaccguaaucagug

SEQ ID NO: 715 - RNA, 59 nt, Human herpesvirus 4
gcuccucuaccugggcaccgcccuuagugauaugagcgguauccccuggccccuggagc

SEQ ID NO: 716 - RNA, 55 nt, Human herpesvirus 4
uugcauuuugggggggcgugccuuuggugacauuaaccucccccgguuuugugga

SEQ ID NO: 717 - RNA, 76 nt, Human herpesvirus 4
guuauuucauggucuuuuuacaaacucauauauuugcugagguuuugaaggaugcgauuaaggaccuuguuaugac

SEQ ID NO: 718 - RNA, 101 nt, Human herpesvirus 4
aggcauuguuaaccuuugguggaaccuaguguuaguguugugcuguaaauaaguguccagcgcaccacuagucaccaggugucaccggaggcuacuugccu

SEQ ID NO: 719 - RNA, 55 nt, Human herpesvirus 4
ccgguuugggcacuggaggugguugauggagaaucaccauuggcaucuccaccgg

SEQ ID NO: 720 - RNA, 55 nt, Human herpesvirus 4
uggaagucuuggcggcguugguauuuaaaaaccagcgaucccugagaacgcucca

SEQ ID NO: 721 - RNA, 56 nt, Human herpesvirus 4
auacaacaacaccuacgaggccccccugagcuccaagauuacggccguugucgugu

SEQ ID NO: 722 - RNA, 56 nt, Human herpesvirus 4
agggaugcguggcaucuccccgccuacaaaugcguggacaggcucgacaaaguucu

SEQ ID NO: 723 - RNA, 55 nt, Human herpesvirus 4
agauacagcacgacggcggagucguugggccuggccacccgccgcuuucuggucu

SEQ ID NO: 724 - RNA, 100 nt, Human herpesvirus 4
gaugaugacugacuacugggacuccugggccucuuuucuccacguccacgaccucucccccuggcucuuucacgacuucccccccuggcucuuucacguc

SEQ ID NO: 725 - RNA, 56 nt, Human herpesvirus 4
cucaaggggcacgagauggcccaguugacggacgugcccagcuccgugguccugag

SEQ ID NO: 726 - RNA, 59 nt, Human herpesvirus 4
ggucacucugcagugccuggugcugcuuuaccuggcaccugaguguggagguacagacc

SEQ ID NO: 727 - RNA, 55 nt, Human herpesvirus 4
guccaagagaaugacagcaaggacggucccucccugaaauccauuuacugggggc

SEQ ID NO: 728 - RNA, 56 nt, Human herpesvirus 4
ggggagcacuacugcugaaucugaggccucuggcccucccagcccacagagccccc

SEQ ID NO: 729 - RNA, 56 nt, Human herpesvirus 4
ugacagcuacgaaacugaccagauggauaccaucuaccagugcuacaacgcgguca

SEQ ID NO: 730 - RNA, 55 nt, Human herpesvirus 4
ccgcaaaggccaaagggagacacaagggugggcuaacucuauggccagagcuagg

SEQ ID NO: 731 - RNA, 75 nt, Human herpesvirus 4
cuggaacacccugcuggccucccugcugccagacaauacggacucagccgcggcagcagcggcggcaguagccag

SEQ ID NO: 732 - RNA, 88 nt, Human herpesvirus 4
acgcaagcgccgucuggccaccguucuccccggacucgaggucuagagaccccuggggcggcgaugucggggcugcuggcggcggcgu

SEQ ID NO: 733 - RNA, 110 nt, Human herpesvirus 4
ugagaaugacaaccccgggcuuggccagagccccccagaguggcuaaagggucacuaccagacgcugugcaccaacuuuaggagccuggccaucgacaaggggguccuca

SEQ ID NO: 734 - RNA, 92 nt, Human herpesvirus 4
caccacccccgaccucagcuccgagugggacgugacccaggcccucuauaggcaccuggggcgcuaccucuuucagcgagccggggugggug

SEQ ID NO: 735 - RNA, 55 nt, Human herpesvirus 4
ccccacguacugcaggaugucgugcgcauaggugcugacucugacaugggcgggg

SEQ ID NO: 736 - RNA, 56 nt, Human herpesvirus 4
uaccacaagcuccggcugcccgucucggccuacgaggcccuggccguggccaggua

SEQ ID NO: 737 - RNA, 55 nt, Human herpesvirus 4
cccaacaaagauuguuaguggaauuaauggagugucugacaguuguuccugguag

SEQ ID NO: 738 - RNA, 56 nt, Human herpesvirus 4
ggguaccagacgucuuguaaauuaacuuguagcgguuaagcauagacgccaaaucu

SEQ ID NO: 739 - RNA, 57 nt, Human herpesvirus 4
uaguaggguccagucucaggcccccucacuuugggucuuagaaugguggccgggcug

SEQ ID NO: 740 - RNA, 55 nt, Human herpesvirus 4
accaagagagcaagaaagauacgcucgggaagccgagguacgcuuccuucguggu

SEQ ID NO: 741 - RNA, 56 nt, Human herpesvirus 4
ccugaugucacaggggccgucugugcaugugugugggcgcagcuuggacucgcagg

SEQ ID NO: 742 - RNA, 87 nt, Human herpesvirus 4
cagcauaguugucacuacgggacccaugaaguguuacagaauccaaguuacuguuuccaauucaggguccaguacaaacaacagcug

SEQ ID NO: 743 - RNA, 56 nt, Human herpesvirus 4
ucugauaaaugaccucuugcauggccucuuguaaagcgcaguguaggauggguaga

SEQ ID NO: 744 - RNA, 76 nt, Human herpesvirus 4
ggagauccgccaggaccuggaugcuguaguggccuucucugauggccuggagagcaugcaggucaggucccccucc

SEQ ID NO: 745 - RNA, 57 nt, Human herpesvirus 4
cgcgcuugacgggggcagcuuggaggcugugcucccgcccgcuccuguacgacgcag

SEQ ID NO: 746 - RNA, 56 nt, Human herpesvirus 4
aaugcagguuugacuucauauguaugccuuggcaugacgucaacuuuacuuuuauu

SEQ ID NO: 747 - RNA, 56 nt, Human herpesvirus 4
ggaccggcaguaugccucgacgucuguccgcggggccgccgccaccgcugccgucc

SEQ ID NO: 748 - RNA, 55 nt, Human herpesvirus 4
gagccuagagguagguauccauaggguuccauuauccuggagguauccuaagcuc

SEQ ID NO: 749 - RNA, 143 nt, Human herpesvirus 4
ggaucaggaugauggaggcgaugaacaugccgcaguagaagccaaaguugugccgcaggaaggaggccagccacaccuccgucagaauguaccagaagaugggcaggaugaggaagagguucacggcucccagcaccaugucc

SEQ ID NO: 750 - RNA, 67 nt, Human herpesvirus 4
guaacauuuguauugugaggaaaggccuuuagauauagaggcucucccaacacaauagaauuuuugc

SEQ ID NO: 751 - RNA, 55 nt, Human herpesvirus 4
gcugcaugugcucuuccccccggccaucuuugccggaacggugaccuucgacagc

SEQ ID NO: 752 - RNA, 81 nt, Human herpesvirus 4
ggcccccacuuuuaaauucuguugcagcagauagcugauacccaauguuaucuuuugcggcagaaauugaaagugcuggcc

SEQ ID NO: 753 - RNA, 105 nt, Human herpesvirus 4
aggcccuuguggccucaaacacugacauugcggaggccauccucgaugccauccucucgcggccugacgagggcuuccgccuguuuuguuugugccacaacgccu

SEQ ID NO: 754 - RNA, 56 nt, Human herpesvirus 4
ccgcccaugggcgcgaguuuaguaaguuauccaagcaugcugcccagcugaagcgg

SEQ ID NO: 755 - RNA, 55 nt, Human herpesvirus 4
gcccccggccgcgccagccaagcccccaaggggggcggggagcgggcaauggagc

SEQ ID NO: 756 - RNA, 81 nt, Human herpesvirus 4
cccgccucagcgccgccgccgccgacuccuacugggacaccuggcccgacguggaguccaacgccggggagcugcuucggg

SEQ ID NO: 757 - RNA, 55 nt, Human herpesvirus 4
gagaccuauguauaaagucaauaaaaauuuauuaaucagaaauuugcacuuucuu

SEQ ID NO: 758 - RNA, 56 nt, Human herpesvirus 4
cgagcggagaguuguauuggggccgcaccgucgcccgccccccgacucucaccuug

SEQ ID NO: 759 - RNA, 55 nt, Human herpesvirus 4
ucugcggggacgcauccgccaaccgucaauuuggcuuuaugauuagucccacgga

SEQ ID NO: 760 - RNA, 58 nt, Human herpesvirus 4
cgagcuucucccgcugggcccagucucacgccagcgagcucgauccccgggagauucg

SEQ ID NO: 761 - RNA, 96 nt, Human herpesvirus 4
ucuacuacuggguaucauaugcugacuguauaugcaugaggauagcauaugcuacccggauacagauuaggauagcauauacuacccagauauaga

SEQ ID NO: 762 - RNA, 56 nt, Human herpesvirus 4
ggcucucgaagcuggugaccaguucaucaauguuaaaguucacaagcuucucggcc

SEQ ID NO: 763 - RNA, 59 nt, Human herpesvirus 4
gccacucucauccucaucaauagguaacccaaaggcagccuggcugagaugauauuggu

SEQ ID NO: 764 - RNA, 164 nt, Human herpesvirus 4
cgugguuuucccucuaaugcugcuccggagccagcuucucuccuauagugacuuuauucaaguuuuggccacguuuaccgcagacccgggggacaccauagucuggaugaaguuaaacguggaggagaacaugcgccgccugaagaagcgagggaggaaacaug

SEQ ID NO: 765 - RNA, 65 nt, Human herpesvirus 4
ccgcgcgggcgcagccaugcgugaccgugaugagggggcagggucgcagggggugugucuggugg

SEQ ID NO: 766 - RNA, 67 nt, Human herpesvirus 4
gcucgcggggcaguauuuucgaccgagguccucgauguagauggccaggcgacugcuccgguagagc

SEQ ID NO: 767 - RNA, 86 nt, Human herpesvirus 4
ucagguguggaauuuagauagagugggugugugcucuuguuuaauuacaccaagaucaccacccucuauccauaucccacaauuga

SEQ ID NO: 768 - RNA, 85 nt, Human herpesvirus 4
agacguuaguaacauuuguauugugaggaaaggccuuuagauauagaggcucucccaacacaauagaauuuuugcagcuaaguuu

SEQ ID NO: 769 - RNA, 73 nt, Human herpesvirus 4
ggcugggccucacccucggggaccccuggacaucuggacaaaguuugggggcgcccgggggucgggcugggcc

SEQ ID NO: 770 - RNA, 55 nt, Human herpesvirus 4
cccggcguuggacuccacgucgggccaggugucccaguaggagucggcggcggcg

SEQ ID NO: 771 - RNA, 83 nt, Human herpesvirus 4
aaagggggcgaucugauucaggcaggagucuucugcuaucauaaguugcgaggaggcuuuaauguuggacucaggcccgcuuu

SEQ ID NO: 772 - RNA, 56 nt, Human herpesvirus 4
ccugggcuuuguggcaccaaccuccgcccauccuucagaggagccacuagcacagg

SEQ ID NO: 773 - RNA, 66 nt, Human herpesvirus 4
ucaaggaccuggaauguggggaugagcugcgccuacagaucaucaacuauacccagcucauuuugg

SEQ ID NO: 774 - RNA, 56 nt, Human herpesvirus 4
ucucgauggccagccggggccacaggcauaagagaggcagguuggccagaaagaga

SEQ ID NO: 775 - RNA, 64 nt, Human herpesvirus 4
ggacgaggaggaagagacuucacagagcagcagcuacacucuggggucucaggccucccagucu

SEQ ID NO: 776 - RNA, 56 nt, Human herpesvirus 4
agcagaugugcccaagccuggauguugacuccauuaucccccggacaccagauguu

SEQ ID NO: 777 - RNA, 64 nt, Human herpesvirus 4
ccuggacacuggacccaggcggcgcaugaggcgcaguaccucacgccgcacgguccggcacagg

SEQ ID NO: 778 - RNA, 55 nt, Human herpesvirus 4
ucgagaccaccagagaaaacgaaaagcgccuccgcaccauccuggacgacaucga

SEQ ID NO: 779 - RNA, 140 nt, Human herpesvirus 4
gcccggggggauuugcggggucugccggaggcaguacggguacagauuucccgaaagcggcggugugugugugcauguaagcguagaaaggggaaguagaaagcguguguuuguguuagaaaagcggguccccggggggc

SEQ ID NO: 780 - RNA, 63 nt, Human herpesvirus 4
cuccggcucguggaguccgcaccuccuucugugcacgaaguuuugcggaaccaggagaagggg

SEQ ID NO: 781 - RNA, 200 nt, Human herpesvirus 4
ggaggggccuggcuccgccggguggcccugggguaagucugggaggcagagggucggccuaggcccggggaaguggagggggaucgcccgggucucuguuggcagaguccgggcgauccucugagacccuccgggcccggacggucgcccucagccccccagacagaccccagggucuccaggcaggguccggcaucuuc

SEQ ID NO: 782 - RNA, 200 nt, Human herpesvirus 4; identical to SEQ ID NO: 781

SEQ ID NO: 783 - RNA, 200 nt, Human herpesvirus 4; identical to SEQ ID NO: 781

SEQ ID NO: 784 - RNA, 200 nt, Human herpesvirus 4; identical to SEQ ID NO: 781

SEQ ID NO: 785 - RNA, 200 nt, Human herpesvirus 4; identical to SEQ ID NO: 781

SEQ ID NO: 786 - RNA, 200 nt, Human herpesvirus 4; identical to SEQ ID NO: 781

SEQ ID NO: 787 - RNA, 56 nt, Human herpesvirus 4
ccugguccaagaguaaaagcagaacaguaaacacugccauaaguccucauggcagg

SEQ ID NO: 788 - RNA, 64 nt, Human herpesvirus 4
gaaagucccgagcggccuccgccguccacucuaucccgcuggaggcaauggucgccaggguuuc

SEQ ID NO: 789 - RNA, 56 nt, Human herpesvirus 4
ccgcguaccagccauuguagaugagaauguuggucacuaucuugguguaggagcgg

SEQ ID NO: 790 - RNA, 55 nt, Human herpesvirus 4
agcuuauuuuuugguugugcggucuguuuuccccgcguuuuccgauagaauagcu

SEQ ID NO: 791 - RNA, 86 nt, Human herpesvirus 4
ggcuucuguugggucagacaguuuggugcgcuaguugugugcuuagcagcaacgcacaccaggcugacugccuuagcaguguggcc

SEQ ID NO: 792 - RNA, 56 nt, Human herpesvirus 4
agguuaugacauuuuauuuacagccauggccaauuguaguuguuauugcccuuaau

SEQ ID NO: 793 - RNA, 113 nt, Human herpesvirus 4
auguucgaagaugaaguguucuccaacagccuggaaucgggauccagugcccccacgucccccaucacacuggacaccgccaggagccaauacuaucagaccaccuuugacau

SEQ ID NO: 794 - RNA, 178 nt, Human herpesvirus 4
ggacuuugguuggcaagcagacaggcggcgcauuggaaccccagaggagugucccggggccaccucuuugguucuguacauauuuuguuauuguacauaaccauggaguuggcuguggugcacuccaucugguaagggggcuggugcggacgccuguguuuagucuaugccaauguuu

SEQ ID NO: 795 - RNA, 56 nt, Human herpesvirus 4
ccugugcuaguggcuccucugaaggaugggcggagguuggugccacaaagcccagg

SEQ ID NO: 796 - RNA, 56 nt, Human herpesvirus 4
agugucagauuucggguccaaaucacuaccagagauuaccuguuacugcacccgcu

SEQ ID NO: 797 - RNA, 56 nt, Human herpesvirus 4
gcucuagcaggguaaagagccgguuuuuaauccgggagauuuuugccucucgaugc

SEQ ID NO: 798 - RNA, 55 nt, Human herpesvirus 4
cggauggcaucggccgccguccuggcgcgaaagagggccccggccgcuuccuccg

SEQ ID NO: 799 - RNA, 78 nt, Human herpesvirus 4
cccguggggggucuuaguggaagugacgugcugugaauacagguccauagcaccgcuauccacuaugucucgcccggg

SEQ ID NO: 800 - RNA, 64 nt, Human herpesvirus 4
ccgguacccuacgcugccgauuuacauaauauaaauuguaaaugcugcaguaguagggaucugg

SEQ ID NO: 801 - RNA, 56 nt, Human herpesvirus 4
gccguacuuugguuguggaccaggcccaagaacucggggugcggccagagggcggc

SEQ ID NO: 802 - RNA, 74 nt, Human herpesvirus 4
guguuauuuuaacgaagagcgugaagcaccgcuugcaaauuacgugugugcuuacacacuucccguuagaacac

SEQ ID NO: 803 - RNA, 56 nt, Human herpesvirus 4
gagcucggggggcggccggguggcccaccggguccgcuggguccgcugccccgcuc

SEQ ID NO: 804 - RNA, 56 nt, Human herpesvirus 4; identical to SEQ ID NO: 803

SEQ ID NO: 805 - RNA, 56 nt, Human herpesvirus 4; identical to SEQ ID NO: 803

SEQ ID NO: 806 - RNA, 56 nt, Human herpesvirus 4; identical to SEQ ID NO: 803

SEQ ID NO: 807 - RNA, 55 nt, Human herpesvirus 4
cuucuccccucgcugccucacuguaaugaagacguuggaacaggcgggguugagg

SEQ ID NO: 808 - RNA, 55 nt, Human herpesvirus 4
cuacuccgagucuuucgagccagagauguccaucuuugcacgccaggccgugugg

SEQ ID NO: 809 - RNA, 56 nt, Human herpesvirus 4
gccaucaacagguggggguuguuggucccgcccaucaucccccgagcagcuuuggc

SEQ ID NO: 810 - RNA, 56 nt, Human herpesvirus 4
ggugucugcagcaaaagaggaacuugcccaggcagucaguuauuuugcaugccacc

SEQ ID NO: 811 - RNA, 55 nt, Human herpesvirus 4
uuggucucggccccggcccuaagucugagccccaggcaaagggccggacucccag

SEQ ID NO: 812 - RNA, 110 nt, Human herpesvirus 4
gugauggccgcggcugccacccgcccuccuccucuuacccuggguggcaaaaaguaugccaggaguagaacaauaacaagugcgauggcgguaaacaauggcacccucac

SEQ ID NO: 813 - RNA, 67 nt, Human herpesvirus 4
ggauuggaagaaaugacgcuggagaagcugcacauuuuuaagcaaaaagccagcguguuucuuaucc

SEQ ID NO: 814 - RNA, 55 nt, Human herpesvirus 4
gcuuuuagccacggaggacauucucucugugaaaacggggaauacguggcggagc

SEQ ID NO: 815 - RNA, 56 nt, Human herpesvirus 4
ucucuuucuggccaaccugccucucuuaugccuguggccccggcuggccaucgaga

SEQ ID NO: 816 - RNA, 57 nt, Human herpesvirus 4
cugaggcugcugcuuuccucggaugccaaagaagacguugagaugcguguagcccag

SEQ ID NO: 817 - RNA, 68 nt, Human herpesvirus 4
gccaucauccccugcuugggacccgaccgcacuugcaugcggccggugguccugcggggggugacggu

SEQ ID NO: 818 - RNA, 56 nt, Human herpesvirus 4
cggagguguuggagucauuuacccauucuaggguaaggcuauaauuguaacccccg

SEQ ID NO: 819 - RNA, 61 nt, Human herpesvirus 4
ggcagguggagugggacacaguuagagaacauuaguccucuggucccuaucuccacccgcc

SEQ ID NO: 820 - RNA, 55 nt, Human herpesvirus 4
aacagguggucgugggauggcggggccuugucugccucgggucucgccgcuaguu

SEQ ID NO: 821 - RNA, 83 nt, Human herpesvirus 4
ggaauuugucuucuggcacagcuguugccagggugcucaugagcgagggccagaugcaggagcugacccaggcgacgagaucc

SEQ ID NO: 822 - RNA, 78 nt, Human herpesvirus 4
gugaccuaacacccgcccaucaccaccggacagauucugaacuuguccugugguguuuggugugguuuugggguacgc

SEQ ID NO: 823 - RNA, 55 nt, Human herpesvirus 4
ggcauaugcucuauacccgccccuccggggggcccaggaucuauagguaugggcu

SEQ ID NO: 824 - RNA, 70 nt, Human herpesvirus 4
uucaucccaguucuuguuacaugggcgaaaucacucaucguucgauguuucagaagaggaaggggaagaa

SEQ ID NO: 825 - RNA, 56 nt, Human herpesvirus 4
cguaccgggccagcagagcaagcggaccacgcccauucgaacccuaccggcggaug

SEQ ID NO: 826 - RNA, 91 nt, Human herpesvirus 4
ccaagcagugcggcggcggucucuggaucgugauagcgucuucugcguaggccuggaaaacggucccuggcugccugcaaugcucugcugg

SEQ ID NO: 827 - RNA, 56 nt, Human herpesvirus 4
uguacaucuuuugcaggcuuuccacggccaccgcgugguugcccagcuugaugacg

SEQ ID NO: 828 - RNA, 56 nt, Human herpesvirus 4
gugagcagggcuucguccaggggcuuguucuuggcggacaucauuagcccagccgc

SEQ ID NO: 829 - RNA, 55 nt, Human herpesvirus 4
gggagucuugguagaagcacagggggggcugaggcccccgcacauccaccacccc

SEQ ID NO: 830 - RNA, 57 nt, Human herpesvirus 4
cccagcuccagcagcucuucccgugaggcagggagggggcgcugcuggugugaggag

SEQ ID NO: 831 - RNA, 56 nt, Human herpesvirus 4
agaagcugggagaugguggcuauagaucccugaauguaguuauaguaaaugcaucu

SEQ ID NO: 832 - RNA, 56 nt, Human herpesvirus 4
ucuaaaguuccucaacaggccagauacguucucgguggccuugggggagcuggggg

SEQ ID NO: 833 - RNA, 69 nt, Human herpesvirus 4
ggcaagagcuccaaagccaggcucgagaagucauagucauccucggccacacggccggagcuccgggcc

SEQ ID NO: 834 - RNA, 55 nt, Human herpesvirus 4
ggaaauuggugccccucucugcccuccugacgaggccauggugucauccaucucc

SEQ ID NO: 835 - RNA, 56 nt, Human herpesvirus 4
ggcacccgggcccgcgucgagccuucacccgaaugugucugcgggccacgguggcc

SEQ ID NO: 836 - RNA, 175 nt, Human herpesvirus 4
ggcacccaggcagccuugcguggugcuguccugcugaagggcguuucuuagguucucggucagacggccgcgcugcgaggcauacagcauguucaacgcggucaaggccgauaugcccgaugacccgaugcucgcccgcagguaugggcagugucuggaacuggcacuggaggcc

SEQ ID NO: 837 - RNA, 64 nt, Human herpesvirus 4
aggacagggguguggccaauaucccagccgagucguauuuaaaggccagcgacgccccggaccu

SEQ ID NO: 838 - RNA, 56 nt, Human herpesvirus 4
accacaccaaacaccacaggacaaguucagaaucuguccgguggugaugggcgggu

SEQ ID NO: 839 - RNA, 55 nt, Human herpesvirus 4
gugacguuaauuggaagcuucuuagaccgcauaguuagagccaauucuccugcac

SEQ ID NO: 840 - RNA, 56 nt, Human herpesvirus 4
gguacugggggugcgccgugaaggcggcggcgcaguccgccuucagcgccuccacc

SEQ ID NO: 841 - RNA, 55 nt, Human herpesvirus 4
ccuaggcuuggauggcggagucagcgacggugaugaagguggccccgggcgcagg

SEQ ID NO: 842 - RNA, 55 nt, Human herpesvirus 4; identical to SEQ ID NO: 841

SEQ ID NO: 843 - RNA, 56 nt, Human herpesvirus 4
uugagcugccuaccaugcuauaaguugcuggcaaagugcugagagcaaggcaccaa

SEQ ID NO: 844 - RNA, 63 nt, Human herpesvirus 4
ccgaugagacaacggccgagaucucuugcgcccaggcaccggucucguccaucuugagcgccg

SEQ ID NO: 845 - RNA, 55 nt, Human herpesvirus 4
cuaauccgucagcagcguguucacaaacuuguuaaagcagacguacaucagguag

SEQ ID NO: 846 - RNA, 56 nt, Human herpesvirus 4
ugcauccgccgguaggguucgaaugggcgugguccgcuugcucugcuggcccggua

SEQ ID NO: 847 - RNA, 56 nt, Human herpesvirus 4
cucauguuggucauggguaggcucucacggacguugaggcccgaggcacggaagag

SEQ ID NO: 848 - RNA, 56 nt, Human herpesvirus 4
uccauggcacauuuagagauaaacauagaugucuugucuugcucaugugcagagga

SEQ ID NO: 849 - RNA, 63 nt, Human herpesvirus 4
uggaugagguuagcguggacaguuugauacucaccaagauuguuccaggucagaccuacgcca

SEQ ID NO: 850 - RNA, 55 nt, Human herpesvirus 4
gagauugccaagaugcaacagaggauuggcugcaucuuaccccuggcuuccacuc

SEQ ID NO: 851 - RNA, 67 nt, Human herpesvirus 4
gcgcgccccccgggccccagugcugugaucgagcaucuggggucccuaguuccaaaggggggucugc

SEQ ID NO: 852 - RNA, 55 nt, Human herpesvirus 4
uagcacagcaccacccugagccgcgaccaguagucguaguggucguuguacacug

SEQ ID NO: 853 - RNA, 57 nt, Human herpesvirus 4
ugccgggagccggaacuggacacggaaacgcugacuaccauguuugagguuucugug

SEQ ID NO: 854 - RNA, 59 nt, Human herpesvirus 4
ugacggggccccuccgaugccuggggaguccccccaggcggucggacugcgcccccuca

SEQ ID NO: 855 - RNA, 65 nt, Human herpesvirus 4
ggucgagcacgcgccggcagcgugucugcacaaacuugcaggccgucuuccggacgagcuccacc

SEQ ID NO: 856 - RNA, 56 nt, Human herpesvirus 4
cgacccgugacugguagcugucucgucgcuuugugggaccucuggucuugguuucg

SEQ ID NO: 857 - RNA, 200 nt, Human herpesvirus 4
cuacccagauauaaauuaggauagcauauacuacccagauauagauuaggauagcauaugcuacccagauauagauuaggauagccuaugcuacccagauauagauuaggauagcauaugcuacccagauauagauuaggauagcauaugcuauccagauauuuggguaguauaugcuacccagauauaaauuaggauag

SEQ ID NO: 858 - RNA, 56 nt, Human herpesvirus 4
agccaccauuuuaccagggacgaggacauccucgacaauuuggagaaugggacgcu

SEQ ID NO: 859 - RNA, 187 nt, Human herpesvirus 4
guccagcaagaaacaaaguccagcuaaaccuucuggauccaggaauguugucuucaauuaauguagaccagccgcccuguugaugaauccaaccauccaggccuucgcuggcuucuaacaucccacgaacugacagguccacaacauaguaaggaguagacugguuacaacacaauguccugcaggc

SEQ ID NO: 860 - RNA, 91 nt, Human herpesvirus 4
ggucacgcauggcugcgcccgcgcggcgccccccgacccccccgauccccggaacguccgccgccauccaccgcccgcagcccccggagcc

SEQ ID NO: 861 - RNA, 55 nt, Human herpesvirus 4
ucacauaaaguccccccuggacgggacugggguggacacaggggggcggggaugg

SEQ ID NO: 862 - RNA, 55 nt, Human herpesvirus 4; identical to SEQ ID NO: 861

SEQ ID NO: 863 - RNA, 69 nt, Human herpesvirus 4
ggcccggagcuccggccguguggccgaggaugacuaugacuucucgagccuggcuuuggagcucuugcc

SEQ ID NO: 864 - RNA, 56 nt, Human herpesvirus 4
cggccucccgccugccgccaacgaccucccaacguugcgcgccccgcgccucuuug

SEQ ID NO: 865 - RNA, 56 nt, Human herpesvirus 4
ucgcguauaugagugugguccuucuugcauaaccauccuacaaacucaauaaauga

SEQ ID NO: 866 - RNA, 56 nt, Human herpesvirus 4
gggcggugacauuuucaaauuuaaccagaucugagaaaaaugcacaaacagacccc

SEQ ID NO: 867 - RNA, 57 nt, Human herpesvirus 4
gcacgauguuggagcgggccaaggccuucguggaggcccugagccccgccaaccugc

SEQ ID NO: 868 - RNA, 56 nt, Human herpesvirus 4
ucacuucugaggacgcaaacucgccaaauguuacagugacugccuuuugggccugg

SEQ ID NO: 869 - RNA, 55 nt, Human herpesvirus 4
gagcuccuaggucagaccacgaaaggucagccugcaagguggauggcguguuuuc

SEQ ID NO: 870 - RNA, 56 nt, Human herpesvirus 4
guccuugcggcggccuccccccccaugaagcggguggcgcggggucccugccuggc

SEQ ID NO: 871 - RNA, 129 nt, Human herpesvirus 4
ggugggcggcccgggcuccagcagaacgucgcagacccagcccuccucggcccuguccaccuguauguccaggugcacggacccggaggcugcgucucgugacauggccaggccuggugccagccgacc

SEQ ID NO: 872 - RNA, 55 nt, Human herpesvirus 4
ccugcacgagaccccugggcucucaggaacuccgcccaggucuugccaauugggg

SEQ ID NO: 873 - RNA, 55 nt, Human herpesvirus 4
ucuggagugccuuucgcgugaagcaugcccugagacguacucgaguuaggacuua

SEQ ID NO: 874 - RNA, 104 nt, Human herpesvirus 4
ugaggacccccuugucgauggccaggcuccuaaaguuggugcacagcgucugguagugacccuuuagccacucuggggggcucuggccaagcccgggguuguca

SEQ ID NO: 875 - RNA, 56 nt, Human herpesvirus 4
ggcgccaggcgcggggccggucggcucggcuggccgagacccgggucuggggggcc

SEQ ID NO: 876 - RNA, 56 nt, Human herpesvirus 4; identical to SEQ ID NO: 875

SEQ ID NO: 877 - RNA, 55 nt, Human herpesvirus 4
cuuguucagaagcccagggacuugaggggggcuguuguggugcugguuggggaag

SEQ ID NO: 878 - RNA, 98 nt, Human herpesvirus 4
ccgggcagaaucugcagguagagguagggguucuugaccaaucugaugggcacaauguaccagguaaacuucccuuucucuaugaacaggcugcgcgg

SEQ ID NO: 879 - RNA, 77 nt, Human herpesvirus 4
gugguguucuaacgggaaguguguaagcacacacguaauuugcaagcggugcuucacgcucuucguuaaaauaacac

SEQ ID NO: 880 - RNA, 56 nt, Human herpesvirus 4
cgggggcugcugcugaguuggaggaggagaaagagucgugguggugggggcugcug

SEQ ID NO: 881 - RNA, 109 nt, Human herpesvirus 4
gaugaugagacuuccgagugcacugucccuggacacuggacuaugaugcauuuuuuuagaauuguuucauagucaagguccaggaucaggacacuggauccacaugguc

SEQ ID NO: 882 - RNA, 73 nt, Human herpesvirus 4
ucggucuccccuaggcuuggauggcggagucagcgacggugaugaagguggccccgggcgcagggcaagacga

SEQ ID NO: 883 - RNA, 56 nt, Human herpesvirus 4
gcugggccaggaugacuucauuaaguucaaaagcccccuggucuucccugcugagc

SEQ ID NO: 884 - RNA, 56 nt, Human herpesvirus 4
acuguggucaaucaccucuaucacuacuuucugaaugagaaugucaucuccggggu

SEQ ID NO: 885 - RNA, 56 nt, Human herpesvirus 4
guugggaaaguuguugggugaaagcuacuaucuccaaugcaccaaagacgccggau

SEQ ID NO: 886 - RNA, 55 nt, Human herpesvirus 4
uuugggguugggguagucacugcugggguggggcugguggcauuugggguugggg

SEQ ID NO: 887 - RNA, 168 nt, Human herpesvirus 4
gccggguggcccugggguaagucugggaggcagagggucggccuaggcccggggaaguggagggggaucgcccgggucucuguuggcagaguccgggcgauccucugagacccuccgggcccggacggucgcccucagccccccagacagaccccagggucuccaggc

SEQ ID NO: 888 - RNA, 56 nt, Human herpesvirus 4
uugggcuagcucuuaguuucugggugugagagagggauuaaagugcuuaugcgcaa

SEQ ID NO: 889 - RNA, 56 nt, Human herpesvirus 4
uaagaaacaguagagggcacgaaacaugguguaugcacuuuauuaauaaacaauua

SEQ ID NO: 890 - RNA, 55 nt, Human herpesvirus 4
ggcgcaagggcuggauaccccugugaauggacagguacuaacacgcaauaaaguu

SEQ ID NO: 891 - RNA, 85 nt, Human herpesvirus 4
guugucuuccgcuccaaagaacaaaaacgcgaccguaaaguagcggcugccguagguggucguguugaaggagaaagaagguaac

SEQ ID NO: 892 - RNA, 56 nt, Human herpesvirus 4
ggugugguggaguguugggcuuagcagaaaaaauuaaaguccacuuaccucuggcc

SEQ ID NO: 893 - RNA, 55 nt, Human herpesvirus 4
ugguguuggggcggguguuccucguccucgguuuucggcccugccuccggcccca

SEQ ID NO: 894 - RNA, 55 nt, Human herpesvirus 4
agcucguccggaagacggccugcaaguuugugcagacacgcugccggcgcgugcu

SEQ ID NO: 895 - RNA, 64 nt, Human herpesvirus 4
cuuugaggccaucuucaccuccccgucugauaccaucagugaggcugaaaccaaggccuuugag

SEQ ID NO: 896 - RNA, 55 nt, Human herpesvirus 4
gccugcccuccgccaucaggcguucccacgggggcgccccuggcagagagguggc

SEQ ID NO: 897 - RNA, 81 nt, Human herpesvirus 4
ggcuccuuauuaaccugaucagccccggaguugccuguuucaucacuaaccccgggccugaagagguugacaagaaggguc

SEQ ID NO: 898 - RNA, 55 nt, Human herpesvirus 4
ggguucggacguggagcuagaguccucggacgaugagcugccauauaucgauccc

SEQ ID NO: 899 - RNA, 76 nt, Human herpesvirus 4
cuuugucaagauguucaaggacguggaugcggcgguggacgccgaagugguccaguuuaugaacagcauggccaag

SEQ ID NO: 900 - RNA, 55 nt, Human herpesvirus 4
gcguguacgcggaggccagcgggggacaaacgccccccgucgcggcugugcccgu

SEQ ID NO: 901 - RNA, 56 nt, Human herpesvirus 4
ugguaccuggagguuauucuauugggauaacgagaggaggaggggcuagagguccg

SEQ ID NO: 902 - RNA, 56 nt, Human herpesvirus 4
cagucagccuggugugcguugcugcuaagcacacaacuagcgcaccaaacugucug

SEQ ID NO: 903 - RNA, 55 nt, Human herpesvirus 4
gccugcaagacucuugccaggaacagcccccucugggcugucaggaguggguggc

SEQ ID NO: 904 - RNA, 66 nt, Human herpesvirus 4
agaugcuggacaugacggugguuggauuaaucuugguuaguucucucagcaccauguucugccucu

SEQ ID NO: 905 - RNA, 56 nt, Human herpesvirus 4
gcauaauggcggaccuaggccuaaaacccccaggaagcgggucuaugguuggcugc

SEQ ID NO: 906 - RNA, 56 nt, Human herpesvirus 4; identical to SEQ ID NO: 905

SEQ ID NO: 907 - RNA, 56 nt, Human herpesvirus 4; identical to SEQ ID NO: 905

SEQ ID NO: 908 - RNA, 142 nt, Human herpesvirus 4
ccauccuggccagcccccgucaccccuacacccaccccggcucgcugaaagagguagcgccccaggugccuauagagggccugggucacgucccacucggagcugaggucggggguggugaggaugcagcuggccagagugg

SEQ ID NO: 909 - RNA, 83 nt, Human herpesvirus 4
ggaucugcaggacauggccaggaucaggucucccaguucccacaucugcaaucggagacaggcccaccacgucuucaacuuuc

SEQ ID NO: 910 - RNA, 56 nt, Human herpesvirus 4
cuuucaacacagcaggccucuccucacccucugggagagcguggccgcaaaucagg

SEQ ID NO: 911 - RNA, 55 nt, Human herpesvirus 4
cccucccucucccucguccuggucggaaaagucugaggaggagaaggagaauggg

SEQ ID NO: 912 - RNA, 56 nt, Human herpesvirus 4
uccucugcacaugagcaagacaagacaucuauguuuaucucuaaaugugccaugga

SEQ ID NO: 913 - RNA, 56 nt, Human herpesvirus 4
uuaucuggcacgggugcuggcugucacggccguggcccugcuccugauguuucuga

SEQ ID NO: 914 - RNA, 56 nt, Human herpesvirus 4
ugcuggccuugagggcgcugaggacugcaaacuccacguccagacccugaggcgcg

SEQ ID NO: 915 - RNA, 79 nt, Human herpesvirus 4
gcuuucaccgguggaacucgugacagaugucuacgccacccuaggcaucguggagaucaucgacgagcucuaccggagc

SEQ ID NO: 916 - RNA, 56 nt, Human herpesvirus 4
gaaucuucuccggcagggugacggcggccgccaccuugucacggagccaggaaauc

SEQ ID NO: 917 - RNA, 74 nt, Human herpesvirus 4
uuaccuuccucugcccgcuucuucguauauguguugagaugagucaucccguggagaguagggagggggaggga

SEQ ID NO: 918 - RNA, 56 nt, Human herpesvirus 4
gcagccucccuucaucuccagcaggaccaguuucuggagaacguagcgagcguagc

SEQ ID NO: 919 - RNA, 56 nt, Human herpesvirus 4
gaaggggggcgauggggcggaacgugggugcguggcagcugaucauccucuguguc

SEQ ID NO: 920 - RNA, 92 nt, Human herpesvirus 4
ugaccuuguugguacuuuaagguugguccaauccauaggcuuuuuuugugaaaacccggggaucggacuagccuuagaguaacucaaggcca

SEQ ID NO: 921 - RNA, 55 nt, Human herpesvirus 4
gcaucugcucagcgggacuccgcucauucuguuccucccgcggcaccgacagagc

SEQ ID NO: 922 - RNA, 57 nt, Human herpesvirus 4
cgaggccgggcggaaggaggcgucacuaugugaggccccgcggcaggaggcccagcg

SEQ ID NO: 923 - RNA, 62 nt, Human herpesvirus 4
cuaugacguugcucucuucgugggcccgggagcccccguccacaaagagggccaggucagag

SEQ ID NO: 924 - RNA, 93 nt, Human herpesvirus 4
guauccguguccugacaacauuccccgcaaacaugacauggguuaauuuaaacauguuuuguuugcuugggaaugcucuuagggccuggaagc

SEQ ID NO: 925 - RNA, 55 nt, Human herpesvirus 4
ccagauuuguuguaggagcagcgagccgcgucguugcccugaccgcgcgucgagg

SEQ ID NO: 926 - RNA, 56 nt, Human herpesvirus 4
uaacauuguacagagcuguaauccccgcuacaguauuuucuuugacuauauggcua

SEQ ID NO: 927 - RNA, 58 nt, Human herpesvirus 4
ugaggagcaccggagccaccacagcacaagugauuaggagcagggcccagugcaccca

SEQ ID NO: 928 - RNA, 56 nt, Human herpesvirus 4
gcaccaggcccgcgcaaggucucccagcaugcgguugaucuggcggcgcagggagu

SEQ ID NO: 929 - RNA, 71 nt, Human herpesvirus 4
ccacugacaggucauccaggucuauccgggcuaucucauccggcaccauuuccuggaagagauucaagagg

SEQ ID NO: 930 - RNA, 55 nt, Human herpesvirus 4
agauguccagggguccccgagggugaggcccagcccccucccgccccuguccacu

SEQ ID NO: 931 - RNA, 55 nt, Human herpesvirus 4; identical to SEQ ID NO: 930

SEQ ID NO: 932 - RNA, 55 nt, Human herpesvirus 4; identical to SEQ ID NO: 930

SEQ ID NO: 933 - RNA, 56 nt, Human herpesvirus 4
ggaagccugcuccacagccgagccaaacagcuccuugcccaggacacaggugcgcc

SEQ ID NO: 934 - RNA, 56 nt, Human herpesvirus 4
aaaauacaccagcuauaaggaauugcucaggccaaaguuguuccucagguggcuuu

SEQ ID NO: 935 - RNA, 56 nt, Human herpesvirus 4
ugacagugggagaaacacggccucugagacauguauggggguguucaucucacgca

SEQ ID NO: 936 - RNA, 56 nt, Human herpesvirus 4
gcaccucccuucacaucccagagaccugcuugaaacuguuaugugaaaacauaggc

SEQ ID NO: 937 - RNA, 55 nt, Human herpesvirus 4
gcaggguugcugaggccgggguccagggggacccgagggccuuagaggccaaggc

SEQ ID NO: 938 - RNA, 55 nt, Human herpesvirus 4; identical to SEQ ID NO: 937

SEQ ID NO: 939 - RNA, 55 nt, Human herpesvirus 4; identical to SEQ ID NO: 937

SEQ ID NO: 940 - RNA, 55 nt, Human herpesvirus 4; identical to SEQ ID NO: 937

SEQ ID NO: 941 - RNA, 55 nt, Human herpesvirus 4; identical to SEQ ID NO: 937

SEQ ID NO: 942 - RNA, 55 nt, Human herpesvirus 4
uuagagaguugugggagcgguuggcgaugagcacguugcugaccugcgcggcggg

SEQ ID NO: 943 - RNA, 82 nt, Human herpesvirus 4
ggagguccggccucgugucagcggucucuggcccggccaccagaagggcccucuggaagcccgccgccaccuggccggaauc

SEQ ID NO: 944 - RNA, 56 nt, Human herpesvirus 4
gaaggaagcagggugccagcucuuugagcuuggucaggaucaccuugcuaagacuc

SEQ ID NO: 945 - RNA, 196 nt, Human herpesvirus 4
agaugccggacccugccuggagacccuggggucugucuggggggcugagggcgaccguccgggcccggagggucucagaggaucgcccggacucugccaacagagacccgggcgaucccccuccacuuccccgggccuaggccgacccucugccucccagacuuaccccagggccacccggcggagccaggccccu

SEQ ID NO: 946 - RNA, 196 nt, Human herpesvirus 4; identical to SEQ ID NO: 945

SEQ ID NO: 947 - RNA, 196 nt, Human herpesvirus 4; identical to SEQ ID NO: 945

SEQ ID NO: 948 - RNA, 196 nt, Human herpesvirus 4; identical to SEQ ID NO: 945

SEQ ID NO: 949 - RNA, 196 nt, Human herpesvirus 4; identical to SEQ ID NO: 945

SEQ ID NO: 950 - RNA, 196 nt, Human herpesvirus 4; identical to SEQ ID NO: 945

SEQ ID NO: 951 - RNA, 63 nt, Human herpesvirus 4
ugauauguuugucccccauguaacgcaagauagaauguaggcaugauggcggcagauaaagca

SEQ ID NO: 952 - RNA, 56 nt, Human herpesvirus 4
ccauaaaugaaacacgcuggucagguguuaaaacuuccucccagauuuucgugagg

SEQ ID NO: 953 - RNA, 113 nt, Human herpesvirus 4
guaucccagguucccggccuggaauaucugguuguugccguugacccccguguacuuguugauggucacuggcagcgugacaaccggacgggccuugcagaccuggcuaagac

SEQ ID NO: 954 - RNA, 56 nt, Human herpesvirus 4
gcauccacguuggccucaaagauccgacacccgugcuugucuugcagccacguggc

SEQ ID NO: 955 - RNA, 84 nt, Human herpesvirus 4
ggcgcucggucccuguccccagcggggccagcgcggaggaguacucugaccuggcccucuuuguggacgggggcucccgggccc

SEQ ID NO: 956 - RNA, 70 nt, Human herpesvirus 4
gccaugucuuccaugcucaugucaacagccuuaacagaaggcaaucugacuuugcguggagcugacaugc

SEQ ID NO: 957 - RNA, 61 nt, Human herpesvirus 4
ucccccgccuccagcaccgggacucguacgccgagcucgaguacgacugugaggugggcga

SEQ ID NO: 958 - RNA, 55 nt, Human herpesvirus 4
agcagcuuggaagaggaaauuaugccauuucgcaauaugucccacaucagguucu

SEQ ID NO: 959 - RNA, 55 nt, Human herpesvirus 4
uccgugggacuaaucauaaagccaaauugacgguuggcggaugcguccccgcaga

SEQ ID NO: 960 - RNA, 66 nt, Human herpesvirus 4
ggcgaaacuugggccagcccggggggaccuccccugcuguucccccaguuugccccaucguuuccc

SEQ ID NO: 961 - RNA, 72 nt, Human herpesvirus 4
gucggcucggaaaggcuguaugacuuccuuaaguacacuaaagaugcuguucuuauacagcuucucggccac

SEQ ID NO: 962 - RNA, 55 nt, Human herpesvirus 4
cgcggccccggccuccgcggccccggccuccgcggccccggccuccgcggccccg

SEQ ID NO: 963 - RNA, 55 nt, Human herpesvirus 4
cccagagaacccagcugagaugcccagggauucacagugcuccgguauucauagg

SEQ ID NO: 964 - RNA, 55 nt, Human herpesvirus 4
cccaaugaacauggauguugaggcccuggagcuaaacaauauguuuucagagagg

SEQ ID NO: 965 - RNA, 55 nt, Human herpesvirus 4
cccgacuaucgacccugcauuugcgauguacuuuucuaugacggggauggugagg

SEQ ID NO: 966 - RNA, 56 nt, Human herpesvirus 4
cacgcucgaggcggacagcuucguggaggcccacgggcaugagcagcccgaguaug

SEQ ID NO: 967 - RNA, 55 nt, Human herpesvirus 4
uacgauaaucucacagguggccugcuggccguggcagaguccuggagcuccauua

SEQ ID NO: 968 - RNA, 56 nt, Human herpesvirus 4
aucuggguagcauaugcuauccuaaucuauaucuggguaguauaugcuauccuaau

SEQ ID NO: 969 - RNA, 56 nt, Human herpesvirus 4
aucuggguagcauaugcuauccuaaucuauaucuggguagcauaggcuauccuaau

SEQ ID NO: 970 - RNA, 55 nt, Human herpesvirus 4
gccucugcguccggaguggcucagucuaaggagcccaccacccccaaggccaagu

SEQ ID NO: 971 - RNA, 68 nt, Human herpesvirus 4
guggcggugcuggugacacccgugguccugccggacucugucauccguaagaccuugagcaccgcggc

SEQ ID NO: 972 - RNA, 55 nt, Human herpesvirus 4
cagguuggcggggcucagggccuccacgaaggccuuggcccgcuccaacaucgug

SEQ ID NO: 973 - RNA, 56 nt, Human herpesvirus 4
uuggugacgcggacguaugaggggaagaucucguacuuccacacgccucucaugaa

SEQ ID NO: 974 - RNA, 79 nt, Human herpesvirus 4
gggggcugggccucacccucggggaccccuggacaucuggacaaaguuugggggcgcccgggggucgggcugggccgcc

SEQ ID NO: 975 - RNA, 79 nt, Human herpesvirus 4; identical to SEQ ID NO: 974

SEQ ID NO: 976 - RNA, 79 nt, Human herpesvirus 4; identical to SEQ ID NO: 974

SEQ ID NO: 977 - RNA, 79 nt, Human herpesvirus 4; identical to SEQ ID NO: 974

SEQ ID NO: 978 - RNA, 79 nt, Human herpesvirus 4; identical to SEQ ID NO: 974

SEQ ID NO: 979 - RNA, 79 nt, Human herpesvirus 4; identical to SEQ ID NO: 974

SEQ ID NO: 980 - RNA, 55 nt, Human herpesvirus 4
cggggccgcggaggccggggccgcggaggccggggccgcggaggccggggccgcg

SEQ ID NO: 981 - RNA, 55 nt, Human herpesvirus 4
aggucucugaugagcuggaagaaggcguagagcauguccagcuccgaugggaacu

SEQ ID NO: 982 - RNA, 65 nt, Human herpesvirus 4
gugcgugugucgguggacaaugacguuacgcagcagcuggccccgaaucccgccgacaagcggac

SEQ ID NO: 983 - RNA, 56 nt, Human herpesvirus 4
gcggcugauggcgggggcugcugcugaggaagaaguggagaaggagccggggcggc

SEQ ID NO: 984 - RNA, 72 nt, Human herpesvirus 4
ggggggugauuccuagaggcgaugagacuggcgugcgcuaaaagugucauggccacaaugggguugucugcc

SEQ ID NO: 985 - RNA, 55 nt, Human herpesvirus 4
cggcggggggucgggguccgcgggcuccgggggcugcgggcgguggauggcggcg

SEQ ID NO: 986 - RNA, 56 nt, Human herpesvirus 4
gagcacacguuguuuuggcaauaauccuguacuuuauugcuuuugcucuggguauc

SEQ ID NO: 987 - RNA, 56 nt, Human herpesvirus 4
cagccugacucuggggucucacugcgagaucugcaucaauaggucccagguucaug

SEQ ID NO: 988 - RNA, 63 nt, Human herpesvirus 4
cugcugccccugaagaugccggacccugccuggagacccuggggucugucuggggggcugagg

SEQ ID NO: 989 - RNA, 56 nt, Human herpesvirus 4
ccguuccucauuuugugugccuccucaaauguuccagaagucggccacaggggagg

SEQ ID NO: 990 - RNA, 81 nt, Human herpesvirus 4
uuguuggucguugaugaccccuggagguggcugugcuggugcugcuggugguggcaauugugagggggguaauggcauagg

SEQ ID NO: 991 - RNA, 55 nt, Human herpesvirus 4
uuucauuggaauuauuuugagagaaauuucaauuuuaauuuuaaaauuuucugaa

SEQ ID NO: 992 - RNA, 56 nt, Human herpesvirus 4
cgucuagguugucacuucgcucggccggccagaagagcgcaaguccaagucuggug

SEQ ID NO: 993 - RNA, 55 nt, Human herpesvirus 4
gcuggcgugagacugggcccagcgggagaagcucgggaccgucacacagcuuugu

SEQ ID NO: 994 - RNA, 97 nt, Human herpesvirus 4
ggugaucgguguagcuguacauccagcugcuguaugccugguaacccauaggccauccggcggccaggguuugcagucuccauuuggccugaucucu

SEQ ID NO: 995 - RNA, 56 nt, Human herpesvirus 4
uguaggcaauugcgugccuagaacauugcuaaugugcccuggguuuccugccuuca

SEQ ID NO: 996 - RNA, 55 nt, Human herpesvirus 4
aauuucugccgcaaaagauaacauuggguaucagcuaucugcugcaacagaauuu

SEQ ID NO: 997 - RNA, 56 nt, Human herpesvirus 4
gcugggccaccagaucucgcuuagaacuacucaucuucauaagucaccauguccgc

SEQ ID NO: 998 - RNA, 56 nt, Human herpesvirus 4
cauacucgggcugcucaugcccgugggccuccacgaagcuguccgccucgagcgug

SEQ ID NO: 999 - RNA, 56 nt, Human herpesvirus 4
ucuaucucauuaccgagcauuucuguuuuuacgcugaaauucgagucuugagcuga

SEQ ID NO: 1000 - RNA, 56 nt, Human herpesvirus 4
cguccggcuuucccaucccccaggcacccgcccugggguccggcuuggccgccccg

SEQ ID NO: 1001 - RNA, 75 nt, Human herpesvirus 4
guucaucgucgggggcuucgucgcgugaccuggagaggacggccuccagagccgugugaaagccccgccgagugc

SEQ ID NO: 1002 - RNA, 56 nt, Human herpesvirus 4
gcuccugccccuccugccccuccugcuccugccccuccugccccuccugcuccugc

SEQ ID NO: 1003 - RNA, 84 nt, Human herpesvirus 4
ggugguguguguuuacagggauuaucaagacaaggagcuccgguaggaccuauaggauagggguacccgaggcacagcacuccc

SEQ ID NO: 1004 - RNA, 91 nt, Human herpesvirus 4
gcuggaggaguucgucgggcucaacuccgcagccauauucacauccauguuccucaaauggcucgagggccugucgcagcucgucucuggc

SEQ ID NO: 1005 - RNA, 90 nt, Human herpesvirus 4
cuuggaagcuuuccgaaauucggauaaucacuuuuaucucccgacgacagggccuuuaaacaccuuccaauuucccgaagagcuucuggg

SEQ ID NO: 1006 - RNA, 55 nt, Human herpesvirus 4
gcuugggcugugguaaccggugggcucguaaaaguccagcggggccgcaguuugc

SEQ ID NO: 1007 - RNA, 69 nt, Human herpesvirus 4
ccuuuuaacauuggcagcagguaagccacacgugugacauugcuugccuuuuugccacauguuuucugg

SEQ ID NO: 1008 - RNA, 58 nt, Human herpesvirus 4
cagcuucugggaaacacuguuucggguuccuggguaggacguauuucccgcggggcag

SEQ ID NO: 1009 - RNA, 57 nt, Human herpesvirus 4
gagggcggccuugcgaacaauuauuaguagcuaccaacaagggcccccagaugcccc

SEQ ID NO: 1010 - RNA, 55 nt, Human herpesvirus 4
aaaggcuguaugacuuccuuaaguacacuaaagaugcuguucuuauacagcuucu

SEQ ID NO: 1011 - RNA, 57 nt, Human herpesvirus 4
gaugggcaggacaaggcccugguggacuaccugucggccugcacguccugccacgcc

SEQ ID NO: 1012 - RNA, 56 nt, Human herpesvirus 4
gagcauggacaucucuccgucuuacgaguugcccuggcucucgcuggagucaugcc

SEQ ID NO: 1013 - RNA, 56 nt, Human herpesvirus 4
uaccugucggcccugcgcuacuaugacaccuaucuguauguggggcgcagcgggaa

SEQ ID NO: 1014 - RNA, 87 nt, Human herpesvirus 4
aaugagauucaaggaagaugucuaugauggagaggcagagacccuagcugagccuccacgcuguuucaugcugagcuuuguuuucau

SEQ ID NO: 1015 - RNA, 57 nt, Human herpesvirus 4
cauggcaggcccugcccucaggcccccgaguggccuguucaagaggaggguggccag

SEQ ID NO: 1016 - RNA, 56 nt, Human herpesvirus 4
gagcauucuguagguuaaacgcgaggagaagguuauucuuguuuacgauccaugcc

SEQ ID NO: 1017 - RNA, 58 nt, Human herpesvirus 4
caaugacucggguguguccuugugugaggucucaccuggaauaacacccagacauaag

SEQ ID NO: 1018 - RNA, 56 nt, Human herpesvirus 4
uacaggucgcguaggucuauggggacccuugucuuugguggauugcugaacugggg

SEQ ID NO: 1019 - RNA, 55 nt, Human herpesvirus 4
uagucggaggccaccggcauagugauggucacuccccgcugcccggccagggcca

SEQ ID NO: 1020 - RNA, 57 nt, Human herpesvirus 4
caggaggccccgcggcaggaggccccgcggcaggaggccccgcggcaggaggccccg

SEQ ID NO: 1021 - RNA, 57 nt, Human herpesvirus 4
gaccaccguggugauuuuauucagauaggugcucuuuauauucuccaccagggggcc

SEQ ID NO: 1022 - RNA, 55 nt, Human herpesvirus 4
gagccucaccuguucuccuccuguuuagagguagaauugccaccuggugagcggu

SEQ ID NO: 1023 - RNA, 57 nt, Human herpesvirus 4
uauugcucucguugccaaaaccuguuguaagggccggcacccgcaacauggggaaaa

SEQ ID NO: 1024 - RNA, 59 nt, Human herpesvirus 4
caauggaggggccguugguaccagagcagcagauguucccuggugcccccuuuagccag

SEQ ID NO: 1025 - RNA, 59 nt, Human herpesvirus 4
gaaggagaggccaggggagagggaaggcgacucgcccgggcugccggggucccuccggc

SEQ ID NO: 1026 - RNA, 56 nt, Human herpesvirus 4
gaaagggaaguuuaccugguacauugugcccaucagauuggucaagaaccccuacc

SEQ ID NO: 1027 - RNA, 56 nt, Human herpesvirus 4
aaagugguccugcagcuauuucuggucgcaucagagcgccaggaguccacacaaau

SEQ ID NO: 1028 - RNA, 59 nt, Human herpesvirus 4
gaagacagggaaaggccaucggauaucgacaccgcggcccgagcccagaagguugagac

SEQ ID NO: 1029 - RNA, 58 nt, Human herpesvirus 4
aaacaccagugggcacaacuagcacgucuaacuguguuaguugccuucacuagugaau

SEQ ID NO: 1030 - RNA, 56 nt, Human herpesvirus 4
gaaacucuccggguagccggcacacaucgugccccuuuacccugcccaggggagcc

SEQ ID NO: 1031 - RNA, 108 nt, Human herpesvirus 4
gaaaagcaagaagcauguauacuaagccucccuuuaugugagcccuggagaggucagguuacuuaccccugaaggugaaccgcuuaccaccuccucuucuugcuggac

SEQ ID NO: 1032 - RNA, 108 nt, Human herpesvirus 4; identical to SEQ ID NO: 1031

SEQ ID NO: 1033 - RNA, 55 nt, Human herpesvirus 4
uaaacuuacaucacguguaugugguuuuucaugcagcauacagauuagaggggca

SEQ ID NO: 1034 - RNA, 60 nt, Human herpesvirus 4
aaaaauucuauuguguugggagagccucuauaucuaaaggccuuuccucacaauacaaau

SEQ ID NO: 1035 - RNA, 56 nt, Human herpesvirus 4
uaaccaauaucaucucagccaggcugccuuuggguuaccuauugaugaggaugaga

SEQ ID NO: 1036 - RNA, 58 nt, Human herpesvirus 4
aaaugaguccggugaaggugacguugcauaucaggcgcggcuuccuuccgaauuuugu

SEQ ID NO: 1037 - RNA, 59 nt, Human herpesvirus 4
gaaucgagcggggguggaggggcgucucgacgcucagacuccucgucuucgcucuuggc

SEQ ID NO: 1038 - RNA, 68 nt, Human herpesvirus 4
cacaacuuaugucuggguguuauuccaggugagaccucacacaaggacacacccgagucauugcuccg

SEQ ID NO: 1039 - RNA, 67 nt, Human herpesvirus 4
gacauaccccaaaccaccgcagauggaggcaagcuguccuucuuugaccacgugucuaucugugccc

SEQ ID NO: 1040 - RNA, 57 nt, Human herpesvirus 4
caccuucaucaccgucgcugacuccgccauccaagccuaggggagaccgaagugaag

SEQ ID NO: 1041 - RNA, 55 nt, Human herpesvirus 4
aaccaggcaugauguagaauaaaauuuuaugcaucaucuucuaaucugugccgcu

SEQ ID NO: 1042 - RNA, 62 nt, Human herpesvirus 4
gacccccacagugccgccagucccugcucggccuccgccgccuuccccaccggcgcugcccc

SEQ ID NO: 1043 - RNA, 57 nt, Human herpesvirus 4
aacuccgccagcucaucgccgcuguauuccgcguuuaaaccgauagcaugguggccu

SEQ ID NO: 1044 - RNA, 57 nt, Human herpesvirus 4
cagcuccacgcaaagucagauugccuucuguuaaggcuguugacaugagcauggaag

SEQ ID NO: 1045 - RNA, 55 nt, Human herpesvirus 4
gagcucuuccgcuucaucugggcccacuacgugaggcccacgguggcggcagacc

SEQ ID NO: 1046 - RNA, 65 nt, Human herpesvirus 4
cagguggcagccuguuuauagaugugcaguaccccuuaauguuaggucugcuuuagggcugccag

SEQ ID NO: 1047 - RNA, 58 nt, Human herpesvirus 4
cagucucuuuucccucuucccuuguuauucccauagaauuacagugagguuacacagg

SEQ ID NO: 1048 - RNA, 59 nt, Human herpesvirus 4
gauggaggccaucucgugaugcaccucaaagguuaccgcguccacccuggccucccggc

SEQ ID NO: 1049 - RNA, 57 nt, Human herpesvirus 4
uauaccccaaagcauccagcugauguuggaccacgucagugccuuggcuaggggggg

SEQ ID NO: 1050 - RNA, 61 nt, Human herpesvirus 4
uauacuauucugccacgcccauuuuaucauauaagccugaagcccgugagcuggccugacg

SEQ ID NO: 1051 - RNA, 60 nt, Human herpesvirus 4
caucccuauggccuaagugugugauguguguuuuuacccaucacacaacaacaagguaag

SEQ ID NO: 1052 - RNA, 55 nt, Human herpesvirus 4
gaugucugugguguuugucggcauguccugugaagcuggaaucucaucagagaac

SEQ ID NO: 1053 - RNA, 61 nt, Human herpesvirus 4
uauuugugccuuucgaaaugcguucuggauuacguguucuuuuaugccucuccgcgcguga

SEQ ID NO: 1054 - RNA, 55 nt, Human herpesvirus 4
gccggcuguggccgcaggggucgaggaucagccccgggugccgaucucagccgcc

SEQ ID NO: 1055 - RNA, 57 nt, Human herpesvirus 4
ccaggggcgcgacugaccuggcaccagacucgguaaccagcaagcuccgcuuccuag

SEQ ID NO: 1056 - RNA, 55 nt, Human herpesvirus 4
ccggcccagaaggguacgaagagaaagcgggucgaucaugaugccggugggucag

SEQ ID NO: 1057 - RNA, 57 nt, Human herpesvirus 4
cccacccacuggccccccuugauggcuccgaccggacugucuggggagagggugccg

SEQ ID NO: 1058 - RNA, 57 nt, Human herpesvirus 4
acuagggaacugaggagggcaugaagcccuggcugaugcaacuugaggcagccuaau

SEQ ID NO: 1059 - RNA, 56 nt, Human herpesvirus 4
gcguccgcccggcgcaggaucaaggaccgcccccaggucuuguuguagagggacac

SEQ ID NO: 1060 - RNA, 55 nt, Human herpesvirus 4
gcaauaaccgaggccuucaaggagcgacucuacagcggaaaccugguggccauuc

SEQ ID NO: 1061 - RNA, 57 nt, Human herpesvirus 4
gcgggcaagggcuucuugcgggccaacaccaagguccgcaucaccggccucaucccc

SEQ ID NO: 1062 - RNA, 58 nt, Human herpesvirus 4
acucggcgcucuggccuaagaagccccagcugcugacaaggcgagagcgggacgaucu

SEQ ID NO: 1063 - RNA, 56 nt, Human herpesvirus 4
gcggcugggcuaaugauguccgccaagaacaagccccuggacgaagcccugcucac

SEQ ID NO: 1064 - RNA, 57 nt, Human herpesvirus 4
ccggaagggcucagagugcccgucgcaguagaggaggggagcaacgacccugaccug

SEQ ID NO: 1065 - RNA, 55 nt, Human herpesvirus 4
ccagaaacaggaggagccaaaggagaucaaccaauagaguccaccaguuuuguug

SEQ ID NO: 1066 - RNA, 58 nt, Human herpesvirus 4
acagagguagacgaggcacaggcacccccucugaggaccuguugcuucagagccuuau

SEQ ID NO: 1067 - RNA, 58 nt, Human herpesvirus 4
acagguggccguaggugucacgugaccuuuuccgccggcaccuuuaagcugccgcgau

SEQ ID NO: 1068 - RNA, 57 nt, Human herpesvirus 4
acagacgucgaggcauacugccggucccugagggccggccaaacggcgcgcgcggau

SEQ ID NO: 1069 - RNA, 61 nt, Human herpesvirus 4
acauuuucccaaucucccgccgauaccuguuccugcacaaccgagguagaugggacuucuu

SEQ ID NO: 1070 - RNA, 58 nt, Human herpesvirus 4
gccgcacggacccggcuggcucuggcugcccagauuauccucgcuagucugugcaccc

SEQ ID NO: 1071 - RNA, 55 nt, Human herpesvirus 4
uccgcgcgcgccguuuggccggcccucagggaccggcaguaugccucgacgucug

SEQ ID NO: 1072 - RNA, 59 nt, Human herpesvirus 4
gccgcugacagggcuggaacggagauauccccaucaccucccuucgggcagcagcccuc

SEQ ID NO: 1073 - RNA, 56 nt, Human herpesvirus 4
acccuggcggcugacagaccuugcgucacuuuaggugaacagcggcccaccgguuu

SEQ ID NO: 1074 - RNA, 59 nt, Human herpesvirus 4
gccucgaguaggugccuccagagccccuuuugccccccuggcggcccagcccgaccccc

SEQ ID NO: 1075 - RNA, 60 nt, Human herpesvirus 4
gcccgcgcggcgccccccgacccccccgauccccggaacguccgccgccauccaccgccc

SEQ ID NO: 1076 - RNA, 60 nt, Human herpesvirus 4; identical to SEQ ID NO: 1075

SEQ ID NO: 1077 - RNA, 69 nt, Human herpesvirus 4
uccaccuuuugucuccccucugcagagagccacauucuggaacucgaagcggucucagacaccaacaca

SEQ ID NO: 1078 - RNA, 60 nt, Human herpesvirus 4
gccagaggcgacgcuccuggguuggcguuuccgaagaguagcaggucgcgcguccagauc

SEQ ID NO: 1079 - RNA, 56 nt, Human herpesvirus 4
accccguccguaaagaauagacugacggugaacgccgucucuuucaccacguacuu

SEQ ID NO: 1080 - RNA, 58 nt, Human herpesvirus 4
gcccccuccaacagcccccccacccucauccccuucauggucgcugucagacagaucc

SEQ ID NO: 1081 - RNA, 63 nt, Human herpesvirus 4
cccgaugaugaugacaaccgcggcugucugaagcggcugacgaaaucgguugagauucugaug

SEQ ID NO: 1082 - RNA, 59 nt, Human herpesvirus 4
cccuggcguggaaguuaauguccagagaucaccucugauucuggcccccaacgccucug

SEQ ID NO: 1083 - RNA, 57 nt, Human herpesvirus 4
ccgacccccgggcgcccccaaacuuuguccagauguccagggguccccgagggugag

SEQ ID NO: 1084 - RNA, 61 nt, Human herpesvirus 4
gcgcugaaaccaacggcaacaaauuacuuaccuuguuguugugugauggguaaaaacacac

SEQ ID NO: 1085 - RNA, 59 nt, Human herpesvirus 4
ccggcccuuagaagacuuuagccgcacauccagcaucuuguugcggucguggagggaag

SEQ ID NO: 1086 - RNA, 58 nt, Human herpesvirus 4
gcguagcagucacaaggaccggguggacauugucccccccugacucaaaacuguuuac

SEQ ID NO: 1087 - RNA, 63 nt, Human herpesvirus 4
ccguuccagaugagaggcagccaucuuuaucuuacggucuuccucucuggacacugguguuug

SEQ ID NO: 1088 - RNA, 63 nt, Human herpesvirus 4
gcuaccacgugaugcaguacucgugcaaccccuuugcgcagcccgccugccccaucuucaccc

SEQ ID NO: 1089 - RNA, 61 nt, Human herpesvirus 4
gcucaaguucgcacuuccuauacaguguuaaagccuuguaucggaaguuugggcuucgucc

SEQ ID NO: 1090 - RNA, 61 nt, Human herpesvirus 4
ucuccuguuacccuuuuagaaccacagccuggacacaugugccagacgccuuggccucuaa

SEQ ID NO: 1091 - RNA, 57 nt, Human herpesvirus 4
ucuccuucccgccucccacccgagcccccucagcuugccuccccaccggguccauca

SEQ ID NO: 1092 - RNA, 65 nt, Human herpesvirus 4
ccucuaacuggguucaugggggccaucuaaggcccacgugugacccauguuuccauuaauuuuag

SEQ ID NO: 1093 - RNA, 55 nt, Human herpesvirus 4
uguggacuggggugcgggugcgggugaugguacggaugaucaccccgaguccaag

SEQ ID NO: 1094 - RNA, 55 nt, Human herpesvirus 4
ugacccggggcuccggggugacccagccaagcgugaccaaggggcccguggguga

SEQ ID NO: 1095 - RNA, 55 nt, Human herpesvirus 4; identical to SEQ ID NO: 1094

SEQ ID NO: 1096 - RNA, 55 nt, Human herpesvirus 4; identical to SEQ ID NO: 1094

SEQ ID NO: 1097 - RNA, 55 nt, Human herpesvirus 4
agaggaaggggaagaaacugcaaugucccccagccccaacaugucccuuuccugu

SEQ ID NO: 1098 - RNA, 57 nt, Human herpesvirus 4
ggccccgucauagaucucccagacgguggcguauaugagcucgagaggacggcgggc

SEQ ID NO: 1099 - RNA, 57 nt, Human herpesvirus 4
cgccccaucguucuacgcaggacucggccuggucucggcucuagcgagagauggggg

SEQ ID NO: 1100 - RNA, 58 nt, Human herpesvirus 4
cggggucccuccggccggccugauggacccgguggggaggcaagcugagggggcucgg

SEQ ID NO: 1101 - RNA, 58 nt, Human herpesvirus 4; identical to SEQ ID NO: 1100

SEQ ID NO: 1102 - RNA, 57 nt, Human herpesvirus 4
ggugcacagacuagcgaggauaaucugggcagccagagccagccggguccgugcggc

SEQ ID NO: 1103 - RNA, 56 nt, Human herpesvirus 4
aggcggaagcccucgucaggccgcgagaggauggcaucgaggauggccuccgcaau

SEQ ID NO: 1104 - RNA, 55 nt, Human herpesvirus 4
aggccgugcgcucagucaucuggaauaccaugaucucucuggcuguaagcggcau

SEQ ID NO: 1105 - RNA, 55 nt, Human herpesvirus 4
cguuuacugugccuggcuccuaacacaguauuuugcccccgaggacauugugaag

SEQ ID NO: 1106 - RNA, 56 nt, Human herpesvirus 4
cgugguaggugaucuccuggagccaaaagauggucucuucuagcauggccaccagg

SEQ ID NO: 1107 - RNA, 57 nt, Human herpesvirus 4
agaggucagaaccagaugcuucuuggaguugauuagugaagcuuugucucccgccuu

SEQ ID NO: 1108 - RNA, 55 nt, Human herpesvirus 4
cguggacuaguuggaucacuggagccugcguuggguucacauccacaaaucuagg

SEQ ID NO: 1109 - RNA, 58 nt, Human herpesvirus 4
gguagguguugaggaauuucauguagggcccguugaugauguaguucucccuccuggu

SEQ ID NO: 1110 - RNA, 55 nt, Human herpesvirus 4
aggccacuggaacgccccuuuuccaauucaagcagagugacccguucucgggcgu

SEQ ID NO: 1111 - RNA, 57 nt, Human herpesvirus 4
cgccgcguccaacaacucccggauauggagacguucucccccgaguuugacccggag

SEQ ID NO: 1112 - RNA, 55 nt, Human herpesvirus 4
ugugaacuuucuaugggcugggccuuaccagcauccaucaccgagagggcgcaga

SEQ ID NO: 1113 - RNA, 55 nt, Human herpesvirus 4
ggcgcuugcucgcguuccugccguuacccaggagaauggccgcgaguuuuuuggc

SEQ ID NO: 1114 - RNA, 57 nt, Human herpesvirus 4
agaugggggcgccuggggccgaggccacaccggccaggcccaacauugccucgaugu

SEQ ID NO: 1115 - RNA, 58 nt, Human herpesvirus 4
cgccuccuaucccuggcggaggccgcccgaacggccguggccagacaacaggcugggg

SEQ ID NO: 1116 - RNA, 56 nt, Human herpesvirus 4
ugaugccucuggagcuggggaucuuuggacugggggauuuggcccagccggugcug

SEQ ID NO: 1117 - RNA, 58 nt, Human herpesvirus 4
agaccuuucuauucccagggaaauuuggucucgccucucugaacgcauugugagggau

SEQ ID NO: 1118 - RNA, 59 nt, Human herpesvirus 4
agauacuguuagcccuguguauacgggacagucgugugcauggaaaugguacccugcau

SEQ ID NO: 1119 - RNA, 65 nt, Human herpesvirus 4
cgaccccucguggcauccuucagauucagacgagucugacuacagcgagagcgacgaggaugaag

SEQ ID NO: 1120 - RNA, 58 nt, Human herpesvirus 4
agagcccgagaugccgcacgggggggccucgcacucucccgucguuaucuuggagaau

SEQ ID NO: 1121 - RNA, 55 nt, Human herpesvirus 4
ggagcugcaccggagccugccggaguuuucucccccagaucacggcugucuagac

SEQ ID NO: 1122 - RNA, 55 nt, Human herpesvirus 4
ggauacgggcgccagagucacagguggaggaggucccaggccuggcgucacgcac

SEQ ID NO: 1123 - RNA, 65 nt, Human herpesvirus 4
agauacagccagcucccugaggagccggagaccuuugagugcccggaccgcuggcgagccgagau

SEQ ID NO: 1124 - RNA, 57 nt, Human herpesvirus 4
ggccugcggaaggauuuggacaaugcagugucaaacggaagaaaucaauucguggac

SEQ ID NO: 1125 - RNA, 62 nt, Human herpesvirus 4
ggcaaaacucuaggccuguggagcgcugcuuugccaucaagaauuaugucccgggccuggac

SEQ ID NO: 1126 - RNA, 78 nt, Human herpesvirus 4
agcacgcccuggagcugggauacagccugacgggcgcccucaggcgcagcgucgccuaccgguuccgggauuacacau

SEQ ID NO: 1127 - RNA, 58 nt, Human herpesvirus 4
agccugaggugggcaucagggcgauaaacugugaauugaaaagcccaucccucacaau

SEQ ID NO: 1128 - RNA, 58 nt, Human herpesvirus 4
ugcugggaccucgggugcccgcuggcuccaaccucgggccccuggacuggucucucaa

SEQ ID NO: 1129 - RNA, 58 nt, Human herpesvirus 4; identical to SEQ ID NO: 1128

SEQ ID NO: 1130 - RNA, 58 nt, Human herpesvirus 4; identical to SEQ ID NO: 1128

SEQ ID NO: 1131 - RNA, 56 nt, Human herpesvirus 4
agcugccggcuaagaccaccgccccuguccaccuuguagguaugcggcagccggau

SEQ ID NO: 1132 - RNA, 56 nt, Human herpesvirus 4
cggccaucuggaccaaagaagucgucugccaagaguucagcuaccagaccuggaag

SEQ ID NO: 1133 - RNA, 59 nt, Human herpesvirus 4
uggcauuugggguugggguagucacugcugagguggggcuuguuuuucccaaggugggg

SEQ ID NO: 1134 - RNA, 58 nt, Human herpesvirus 4
gggauuggccgcccccaucacucucccaggcccccgauugauggcaaggcccuauuuc

SEQ ID NO: 1135 - RNA, 56 nt, Human herpesvirus 4
gggagagaggagugaauaccgcgucgacgcccgagaacgggucacucugcuugaau

SEQ ID NO: 1136 - RNA, 56 nt, Human herpesvirus 4
uggaacaggcgggcgaauguguaaucccggaaccgguaggcgacgcugcgccugag

SEQ ID NO: 1137 - RNA, 59 nt, Human herpesvirus 4
cggugccugaugcggauguguuguugguauaggccggaucaacguacacguagagggag

SEQ ID NO: 1138 - RNA, 56 nt, Human herpesvirus 4
cgugggggguaaagaaggugaauaaaaauuacaaacauucucugcccagccuucag

SEQ ID NO: 1139 - RNA, 56 nt, Human herpesvirus 4
gugcaacggggcagggggaggguggcggccauucccgccucucugcccuguuugcc

SEQ ID NO: 1140 - RNA, 56 nt, Human herpesvirus 4
gucaggguggcuacuugcucagguuucugggcauaaauucuccugccugccucugc

SEQ ID NO: 1141 - RNA, 73 nt, Human herpesvirus 4
guagaugugccuggcucuguccagaauguagggccagucaaaguuggccacguuguagccggucacaaucucc

SEQ ID NO: 1142 - RNA, 58 nt, Human herpesvirus 4
augcggguuccaauugugacccaccuaacaaaucauguaccaguaaucaaaccugccu

SEQ ID NO: 1143 - RNA, 55 nt, Human herpesvirus 4
cuacuccacggaccuccagacgcuaaagagcgucguggagggcauccaggaugug

SEQ ID NO: 1144 - RNA, 57 nt, Human herpesvirus 4
auuuccacuugaggugucugauggggagugggucccacuggaugauuaaaugggauu

SEQ ID NO: 1145 - RNA, 55 nt, Human herpesvirus 4
cugggucucagugacauggaagagguugaacuugaaguuauguuauguuggccug

SEQ ID NO: 1146 - RNA, 57 nt, Human herpesvirus 4
cugaagauguaaaauuuacaccugacccauaccaggugccuuuuguacaagcuuuug

SEQ ID NO: 1147 - RNA, 56 nt, Human herpesvirus 4
gucauuuccucuuagaagguaaucccccaucuuaacuucccuuuaaauugugaugc

SEQ ID NO: 1148 - RNA, 55 nt, Human herpesvirus 4
augccaccgugaaguuagaguccaaugauguggacauuguuuuccccauggugcu

SEQ ID NO: 1149 - RNA, 56 nt, Human herpesvirus 4
uucuccugauuugcucuucgugcucuucauguccacugagcaagauccuucuggca

SEQ ID NO: 1150 - RNA, 57 nt, Human herpesvirus 4
aucaguguugucaggguccugaggcagcgggucaugugggccauugucaucaguguu

SEQ ID NO: 1151 - RNA, 58 nt, Human herpesvirus 4
cugaugagguccuggcccgcggcggccgaaccuccgcaggcuguugcuccuucuccug

SEQ ID NO: 1152 - RNA, 59 nt, Human herpesvirus 4
guacgguaguuccaguggaggcuucccgguaauuucccacagcguccaccauauaucuu

SEQ ID NO: 1153 - RNA, 61 nt, Human herpesvirus 4
guacuuguuaaggaacacggucuggucacuaaaguuggucaggcugacguccaccccaccc

SEQ ID NO: 1154 - RNA, 59 nt, Human herpesvirus 4
uuaucgaggugcccaaguugaguugacauuccaacgucgagauacccuggcgccgaaca

SEQ ID NO: 1155 - RNA, 56 nt, Human herpesvirus 4
cucaacggcccccacguccugagccuuggccacagggccagugaaggccucguaug

SEQ ID NO: 1156 - RNA, 65 nt, Human herpesvirus 4
aucaagaagcugcuggcggccugcgaggauccgcgccaaaggaccauccucgacaagcagcagcu

SEQ ID NO: 1157 - RNA, 59 nt, Human herpesvirus 4
gucacgcgggcgagccccccguccaccucugccagggguggcugggcgucugccccucc

SEQ ID NO: 1158 - RNA, 61 nt, Human herpesvirus 4
guccgcauguuuugauccaaacuuuuguuuuaggauuuaugcauccauuaucccgcaguuc

SEQ ID NO: 1159 - RNA, 57 nt, Human herpesvirus 4
cuccgccgccaucaaaaugcuggacaaccccacacagcagcuaccgguggaggcaug

SEQ ID NO: 1160 - RNA, 62 nt, Human herpesvirus 4
cucgcucacgccccucguggaacugcucacacugagcgcuaagaaacagccacagggggaug

SEQ ID NO: 1161 - RNA, 68 nt, Human herpesvirus 4
cucgugccugggccugcaauuuacuaaccucgggaugccauauguuuugcagaaugcccaccagaucg

SEQ ID NO: 1162 - RNA, 60 nt, Human herpesvirus 4
cucuuggagaccucggugcucuaggcacccugggggcccuuggggcucugggcgcucuug

SEQ ID NO: 1163 - RNA, 60 nt, Human herpesvirus 4
cuguggugugcuuuccaccggugguagaauuggccuuuccaccuguugaggugaccgugg

SEQ ID NO: 1164 - RNA, 59 nt, Human herpesvirus 4
gugauguucugugcaguaaccuuaguggugacauugaugguggaugcguuggaaguugu

SEQ ID NO: 1165 - RNA, 62 nt, Human herpesvirus 4
cugaaccuccugaaucacugcaucuuucuugaggcguuuaaagaagagaauaguggccaggg

SEQ ID NO: 1166 - RNA, 65 nt, Human herpesvirus 4
cugauuaucauccuccucauuaccaugggccccgacgccaaucucaacagaggccccaacaugug

SEQ ID NO: 1167 - RNA, 55 nt, Human herpesvirus 4
cugcugagcauggccccccaggaggcaacgcuggaccaggcggccguuucaaaug

SEQ ID NO: 1168 - RNA, 59 nt, Human herpesvirus 4
guugccugggauggggagcggagccccgccgcugucuucuaugcccgaguacuggcucc

SEQ ID NO: 1169 - RNA, 59 nt, Human herpesvirus 4
cuugacccccgugauagggguccuggcccaaaauaaccaccuuaauaucagaggggucg

SEQ ID NO: 1170 - RNA, 58 nt, Human herpesvirus 4
cuuugucuuugccaaccugcucucucuggagaucuucucaccguggcagacacacgug

SEQ ID NO: 1171 - RNA, 63 nt, Human herpesvirus 4
cuuaugcgaauugcgcuggccuggaacaaagaugagguuauaggucaggccuugcaaauauug

SEQ ID NO: 1172 - RNA, 66 nt, Human herpesvirus 4
guuaaucuuuagugggaacuagugggagugcugugccucggguaccccuauccuauagguccuacc

SEQ ID NO: 1173 - RNA, 58 nt, Human herpesvirus 4
uuuacaguggccucauuggaggcgccacaucugugcuucucucggccuacaaccgcca

SEQ ID NO: 1174 - RNA, 57 nt, Human herpesvirus 4
auuacaugcacugccccgcgggaaauacguccuacccaggaacccgaaacaguguuu

SEQ ID NO: 1175 - RNA, 57 nt, Human herpesvirus 4
cuuuacauagagggucuccgucaugucaucaauguuggucaccuucagguguuugug

SEQ ID NO: 1176 - RNA, 56 nt, Human herpesvirus 4
guuucuauucuugagugugaaaguuuguaaaaaaauucauaaaaugucacuaauuc

SEQ ID NO: 1177 - RNA, 59 nt, Human papillomavirus
cauaugggucugcagccauuuguaaauaaucuggauauuuacauguagugccacauaug

SEQ ID NO: 1178 - RNA, 67 nt, Human papillomavirus
gucaggcaaugcaaauuuguuaggaucugguaacaccaccuuaaauacccuguauugauauccugac

SEQ ID NO: 1179 - RNA, 58 nt, Human papillomavirus
ugucccugggcuuuuuguagccaauauggcuuauuaaacaauugugccucagaggaca

SEQ ID NO: 1180 - RNA, 57 nt, Human papillomavirus
uguagacauuauaaacaugcagaaaugaggaagaugucuauaaaacaauggauaaaa

SEQ ID NO: 1181 - RNA, 95 nt, Human papillomavirus
auuuuuauguuauuguauaccaaacaguaagagcaaaaaaaugugcugcuacaagccaaaaaugcuuuuaagaguuggcuacagugcauaaaagu

SEQ ID NO: 1182 - RNA, 56 nt, Human papillomavirus
ugguaggggguauuuuuacaacaucuaaaaacuguugccuuuguuccucacuauca

SEQ ID NO: 1183 - RNA, 86 nt, Human papillomavirus
gauauaccuguacgaaaccaauacagggcugcaacaccacuuuguauuuuugguggcucuauuaacauuugguuuucagguauauu

SEQ ID NO: 1184 - RNA, 55 nt, Human papillomavirus
ugcaccuauuguaauuuguauauauguaaauguguaaauauaugguauuggugua

SEQ ID NO: 1185 - RNA, 56 nt, Human papillomavirus
aguggguaugacaugguggacuuuauugaugacagcaauauuacacacaauucacu

SEQ ID NO: 1186 - RNA, 55 nt, Human papillomavirus
guauauguguguauguacuguuauauguauguguguuguauauauguguguauau

SEQ ID NO: 1187 - RNA, 77 nt, Human papillomavirus
uuguaaaucauacucuuccacaugacgcauguacucuuuauaaucagaauugguguauguggaagauguaguuacgg

SEQ ID NO: 1188 - RNA, 55 nt, Human papillomavirus
aguaugguagaugcuaaggguauauauuacacauguggacaauuuaaaacauauu

SEQ ID NO: 1189 - RNA, 56 nt, Human papillomavirus
ccuccuagaaagcuuauuaaacucauacaaaaguacgauuucccaguaucuggagg

SEQ ID NO: 1190 - RNA, 56 nt, Human papillomavirus
uguuagcaucauugcugugugguaacaauauaguaguguauauacaaugcgggaca

SEQ ID NO: 1191 - RNA, 67 nt, Human papillomavirus
ccugcaccuggugcaaugcacgacuauauaggcccacacgaggccgaggugcaguaccaggaacagg

SEQ ID NO: 1192 - RNA, 72 nt, Human papillomavirus
ucugcgcaccgaagaccuaacaacgauggcggacgauucagguacagaaaaugaggggucuggguguacagg

SEQ ID NO: 1193 - RNA, 56 nt, Human papillomavirus
guccucugaggcacaauuguuuaauaagccauauuggcuacaaaaagcccagggac

SEQ ID NO: 1194 - RNA, 60 nt, Human papillomavirus
guacaugcgucauguggaagaguaugauuuacaauuuauuuuucaauuauguagcauuac

SEQ ID NO: 1195 - RNA, 55 nt, Human papillomavirus
ugaaauugcauuugaauaugcacaaaggggagauuuugauucuaaugcacgagca

SEQ ID NO: 1196 - RNA, 55 nt, Human papillomavirus
uggcaggauaugaugcacuuggcaagcaacuuggcagggcaauguguaccuggca

SEQ ID NO: 1197 - RNA, 56 nt, Human papillomavirus
uugaugauauuaaaucaaauaaaugucugugucugucauuuagccuauaucuaaaa

SEQ ID NO: 1198 - RNA, 56 nt, Human papillomavirus
augaugauuauguaacuaugcauuauacuacugauggugauuauauauauaugaau

SEQ ID NO: 1199 - RNA, 79 nt, Human papillomavirus
guuugcacagaccugccauugcgucccgacguggccuugugcgguacagucgcauuggacaacgggggucuaugcacac

SEQ ID NO: 1200 - RNA, 56 nt, Human papillomavirus
caucuuccacauacaccaauucugauuauaaagaguacaugcgucauguggaagag

SEQ ID NO: 1201 - RNA, 57 nt, Human papillomavirus
gaauaaaucucugcuguggucagugcauucuugcaaaacacacaauuaauuugcaac

SEQ ID NO: 1202 - RNA, 65 nt, Human papillomavirus
ucacaggguguaacaagagguaauuguuuauugcacauaaacacacauacacauuacacaaauaa

SEQ ID NO: 1203 - RNA, 77 nt, Human papillomavirus
ugugcauagacccccguuguccaaugcgacuguaccgcacaaggccacgucgggacgcaauggcaggucugugcaaa

SEQ ID NO: 1204 - RNA, 57 nt, Human papillomavirus
guaccauuugggggaggcgauaacccaaaguuccagucuuccaaaacagagggauuc

SEQ ID NO: 1205 - RNA, 56 nt, Human papillomavirus
guaacaggguguuggguaggguuaaugccagguucaaaagauucagcauaaauauc

SEQ ID NO: 1206 - RNA, 58 nt, Human papillomavirus
augaaccgcgccuugguuaguauauguuuuaccuuuucuacuucacacagcgguuugu

SEQ ID NO: 1207 - RNA, 58 nt, Human papillomavirus
cuuaacaccuguacgaauagaggaccguccccuauauccacuuuguaacaaaaacuug

SEQ ID NO: 1208 - RNA, 55 nt, Human papillomavirus
aaggugucuaaguuuuucugcuggauucaacgguuucuggcaccgcaggcaccuu

SEQ ID NO: 1209 - RNA, 55 nt, Human papillomavirus
gcuguauuaguguuuuaaauccuucugcuauuguuggguuuacuccaaauauagc

SEQ ID NO: 1210 - RNA, 68 nt, Human papillomavirus
ccccuacaucuggaacacauggguaugaggaaauaccuuuacaaacauuugcuucuucugguacgggg

SEQ ID NO: 1211 - RNA, 56 nt, Human papillomavirus
ccuugcacaaagucgauacaaaaccgaggauuggacacugcaagacacaugcgagg

SEQ ID NO: 1212 - RNA, 58 nt, Human papillomavirus
ccaaaaaaaauuguuuaguauuuuguggaccagcaaauacaggaaaaucauauuuugg

SEQ ID NO: 1213 - RNA, 56 nt, Human papillomavirus
guaggaccaacauccaccacuguauuggaacgcccacccaauggaauguacccugu

SEQ ID NO: 1214 - RNA, 103 nt, Human papillomavirus
cucuauaguggucgcuauguuuucgcaaucuguaccguaaacauuuuaaacuguuucugucaccuuuuaaauguauuauaggcguaguguuaccacuacagag

SEQ ID NO: 1215 - RNA, 57 nt, Human papillomavirus
ggauauuugucagucuauuuguaaauauccugauuauuuacaaaugucugcagaucc

SEQ ID NO: 1216 - RNA, 59 nt, Human papillomavirus
guauccacucaggugugucucccauuacuucacuaauauuugauauuccuguucuauac

SEQ ID NO: 1217 - RNA, 56 nt, Human papillomavirus
gcccuagugaguaacaacuguauuuguguuugugguauggguguugcuuguugggc

SEQ ID NO: 1218 - RNA, 55 nt, Human papillomavirus
uuugauuugucagaaaugguacaaugggcauuugauaaugagcugacagaugaaa

SEQ ID NO: 1219 - RNA, 55 nt, Human papillomavirus
uuaguaucugccacggaggacaaugacuuguuugauauauaugcagaugacaugg

SEQ ID NO: 1220 - RNA, 55 nt, Human papillomavirus
auauuagugaaguaaugggagacacaccugaguggauacaaagacuuacuauuau

SEQ ID NO: 1221 - RNA, 56 nt, Human papillomavirus
ucauauuauaguucauguuaaggguagacagaauguuggacaugaaaguaguugua

SEQ ID NO: 1222 - RNA, 60 nt, Human papillomavirus
acauaugggcuaucauuuacagauuuaguuagaaauuuuaaaagugauaaaaccacgugu

SEQ ID NO: 1223 - RNA, 55 nt, Human papillomavirus
gguuccucccccguaccagaagaagcaaauguuuguaaagguauuuccucauacc

SEQ ID NO: 1224 - RNA, 56 nt, Human papillomavirus
guguuggauccucaaagcgcgccauaguauugugguguguuucucacaucuuuuau

SEQ ID NO: 1225 - RNA, 55 nt, Human papillomavirus
acuuucuaaauauggccaucuauuauccuuugcuggauguauauuugugguuagu

SEQ ID NO: 1226 - RNA, 55 nt, Human papillomavirus
aacauauugguacuacagcauauguauuacauugucauguaucccaccaauauuu

SEQ ID NO: 1227 - RNA, 129 nt, Human papillomavirus
ccugcuucaccuggcagcuguguguauucucccucuccaaguggcucuauuguuaccucugacucccaguuguuuaauaaaccauauugguuacauaaggcacagggucauaacaaugguguuugcugg

SEQ ID NO: 1228 - RNA, 56 nt, Human papillomavirus
uguaaccacacuggaguccucuauuaauguaacaauagaugggucuguggggccca

SEQ ID NO: 1229 - RNA, 56 nt, Human papillomavirus
aaaucuaccauauccgacccugugucuguugcauuuucguccucgucaucugauau

SEQ ID NO: 1230 - RNA, 56 nt, Human papillomavirus
aacagcugcuggaaugcucgaaggucgucugcugagcuuucuacuacuagcucaau

SEQ ID NO: 1231 - RNA, 74 nt, Human papillomavirus
aauacuaaacaauuuuuuuuggggguuccuuuuaaaaaugauuuuaaggcuccuaaaaauguuauaaacucuau

SEQ ID NO: 1232 - RNA, 60 nt, Human papillomavirus
uauuaccugucaaaaggaugcugcaccggcugaaaauaaggaucccuaugauaaguuaaa

SEQ ID NO: 1233 - RNA, 59 nt, Human papillomavirus
gcuaugguacauuguggauuuacauuuucuauauugcuauugucacuuguaccgucuac

SEQ ID NO: 1234 - RNA, 62 nt, Human papillomavirus
ucuacccuuaacaugaacuauaauaugacuaagcugugcauacauaguuuaugcaaccgaaa

SEQ ID NO: 1235 - RNA, 60 nt, Human papillomavirus
cgaaaacgguguauauaaaagaugugagaaacacaccacaauacuauggcgcgcuuugag

SEQ ID NO: 1236 - RNA, 58 nt, Human papillomavirus
ugauccagaagguacagacggggagggcacggguuguaacggcugguuuuauguacaa

SEQ ID NO: 1237 - RNA, 55 nt, Human papillomavirus
guucaggcuggauugcgucgcaagcccaccauaggcccucgcaaacguucugcuc

SEQ ID NO: 1238 - RNA, 63 nt, Human papillomavirus
uugagaaaaaggauuuccaguucuuaucauuaagcucauacacuggauuuccguuuucgucaa

SEQ ID NO: 1239 - RNA, 56 nt, Human papillomavirus
aucuauaucuuaaacauuuuaaaguauuagcaucaccuuuuaaauguacuaugggu

SEQ ID NO: 1240 - RNA, 56 nt, Human papillomavirus
uaguucauacaugaacuguguaaagguuagucauacauuguucauuuguaaaacug

SEQ ID NO: 1241 - RNA, 55 nt, Human papillomavirus
guacagaccuacgugaccauauagacuauuggaaacacaugcgccuagaaugugc

SEQ ID NO: 1242 - RNA, 56 nt, Human papillomavirus
acaguuaauccguccuuugugugagcuguuaaaugcagugaggauuggagcacugu

SEQ ID NO: 1243 - RNA, 55 nt, Human papillomavirus
auaccaauauuauuaaugauguguauguagacacagacaaaagcagcggacguau

SEQ ID NO: 1244 - RNA, 90 nt, Human papillomavirus
gcagcucugugcauaacugugguaacuuucugggucgcuccuguggguccugaaacauugcaguucucuuuuggugcauaaaaugucugc

SEQ ID NO: 1245 - RNA, 55 nt, Human papillomavirus
cagguaauauuauguccuacaucuguguuuagcagcaacgaaguauccucuccug

SEQ ID NO: 1246 - RNA, 56 nt, Human papillomavirus
guguuuuauuguauauauuauauuuguuuauauaccauuauuuuuaauacauacac

SEQ ID NO: 1247 - RNA, 56 nt, Human papillomavirus
ucuauaggugcuaagguacauuauuauuaugauuuaaguacuauugauccugcaga

SEQ ID NO: 1248 - RNA, 55 nt, Human papillomavirus
uguaagcacggaugaauauguugcacgcacaaacauauauuaucaugcaggaaca

SEQ ID NO: 1249 - RNA, 55 nt, Human papillomavirus
acaaaaugggccuggcgcuacaaaauauaguauauauaaaacaaaaacaggaugu

SEQ ID NO: 1250 - RNA, 56 nt, Human papillomavirus
gcuaacacagguaaaucauuauuugguaugaguuuaaugaaauuucugcaaggguc

SEQ ID NO: 1251 - RNA, 134 nt, Human papillomavirus
guaugugcuuguaaauauuaaguuguauguguguuuguauguaugguauaauaaacacguguguauguguuuuuaaaugcuuguguaacuauugugucaugcaacauaaauaaacuuauuguuucaacaccuac

SEQ ID NO: 1252 - RNA, 55 nt, Human papillomavirus
aaaucacuaugcgccaacgccuuacauaccgcuguuaggcacauauuuuuggcuu

SEQ ID NO: 1253 - RNA, 55 nt, Human papillomavirus
ugcaaaggcagcaauguuagcaaaauuuaaagaguuauacggggugaguuuuuca

SEQ ID NO: 1254 - RNA, 65 nt, Human papillomavirus
cggugucuggcucugaucuuggucgcuggauagucgucuguguuucuucggugcccaaggcgacg

SEQ ID NO: 1255 - RNA, 55 nt, Human papillomavirus
ugguuggcaagcagugcaggucaggaaaacagggauuuggcacgcauggcaagca

SEQ ID NO: 1256 - RNA, 56 nt, Human papillomavirus
acugcuaaacgcaaaaaacguaagcuguaaguauuguauguauguugaauuagugu

SEQ ID NO: 1257 - RNA, 97 nt, Human papillomavirus
guuuuuaguacauuuaaaauauuuguaagugguguuuggcauauagugugucuuucacuaacacccucucccccacuuccacuacuguacugacugc

SEQ ID NO: 1258 - RNA, 55 nt, Human papillomavirus
aaacuuuuccuuuaaauuuacuucccaaaaaguguauuuuuuaaggggaucaucu

SEQ ID NO: 1259 - RNA, 55 nt, Human papillomavirus
uagcgccaggcccauuuuguagcuucaaccgaauucgguugcaugcuuuuuggca

SEQ ID NO: 1260 - RNA, 57 nt, Human papillomavirus
acgaaaacggaaauccaguguaugagcuuaaugauaagaacuggaaauccuuuuucu

SEQ ID NO: 1261 - RNA, 64 nt, Human papillomavirus
uguacauuguauacugcagugucgucuacauggcauuggacaggacauaauguaaaacauaaaa

SEQ ID NO: 1262 - RNA, 55 nt, Human papillomavirus
agcagcagcauuauauugguauaaaacagguauaucaaauauuagugaaguguau

SEQ ID NO: 1263 - RNA, 61 nt, Human papillomavirus
guuguaccaauggucuaugcuuuacauccauagaaacuaaauuuccauccaaugcauuucu

SEQ ID NO: 1264 - RNA, 56 nt, Human papillomavirus
uuugucuuuguauccauucuggcgugucuccauacacuucacuaauauuugauaua

SEQ ID NO: 1265 - RNA, 77 nt, Human papillomavirus
gaagccacaauuuuaauuuacuuaaaaauggaauaaauucuauauuuugaugccuuaaaaauuguacuauugguuuc

SEQ ID NO: 1266 - RNA, 68 nt, Human papillomavirus
uggcagggcgugggguggauccuacugguacauagccaguccuaccgccaguaccagagccugugcca

SEQ ID NO: 1267 - RNA, 56 nt, Human papillomavirus
ugucacguuuguuuguacuguauguauguuguguacuguauguguaauguuguaug

SEQ ID NO: 1268 - RNA, 64 nt, Human papillomavirus
uugugucuucugaggcccaguuguuuaauaaaccuuauugguuacaaaaggcccagggacacaa

SEQ ID NO: 1269 - RNA, 56 nt, Human papillomavirus
ccugacacaucuauauuugacucaacuagucaacgcuuagugugggccuguacagg

SEQ ID NO: 1270 - RNA, 55 nt, Human papillomavirus
uagcagcgaauuagcacauccaaaauugacugcuuugugucuucuucaacuguua

SEQ ID NO: 1271 - RNA, 56 nt, Human papillomavirus
gcagaaccugacccugacccuguggcuguaaacaccucugggucauugucuucugc

SEQ ID NO: 1272 - RNA, 55 nt, Human papillomavirus
uguggacgugcauaugucuaguggcacaucagauuuauuagauugcaauuccgca

SEQ ID NO: 1273 - RNA, 56 nt, Human papillomavirus
guagaagaauuugauuuacaauuuauuuuucaauugugcacuauuaaauuaacugc

SEQ ID NO: 1274 - RNA, 94 nt, Human papillomavirus
cccaacauauaccauuauugugucccugggccuuuuguaaccaauaagguuuauuaaacaacugggccucagaagacacaagagagccacuggg

SEQ ID NO: 1275 - RNA, 55 nt, Human papillomavirus
uguuaugucaggaccaggcuguauaaauauaucaccugguagugaaagaggaaca

SEQ ID NO: 1276 - RNA, 55 nt, Human papillomavirus
augcguguucugcaggaaaacccuguccacggcagagguuuaugcauuucaguau

SEQ ID NO: 1277 - RNA, 114 nt, Human papillomavirus
aaagucuugucuuuguuguucauuuacauagguuaagguuaccagugcauguuuuugugaauuauuaggggcgguccaaugccauguagaugaugcuaacaaaaauaaaucuuu

SEQ ID NO: 1278 - RNA, 125 nt, Human papillomavirus
cauauggacugccuaaauacuuucguuuuagguccugcacagccgcauaaugagcauccgccuccugcucguuuaacaaugccugugcuuccacggaauuguguguaauaggucugucaucuaug

SEQ ID NO: 1279 - RNA, 56 nt, Human papillomavirus
aauuguuauaacagcauauauuguauguaaauauuuguuguguguguguauauauu

SEQ ID NO: 1280 - RNA, 55 nt, Human papillomavirus
uacuaaaacguuuguguacaccaagaacucugauaugcacaauauuguuauaaug

SEQ ID NO: 1281 - RNA, 56 nt, Human papillomavirus
uguacacaaacguuuuaguacuaacauuaauuuuauauguacuuuuguggcuuuua

SEQ ID NO: 1282 - RNA, 61 nt, Human papillomavirus
ccuccugauguuauaccaaagguugaacaaaacacucuugcagauaaaauauuaaaguggg

SEQ ID NO: 1283 - RNA, 58 nt, Human papillomavirus
guuggggcgacgauaaaaaggcaggaucaguaaccuguacuugauguaaggcccuacu

SEQ ID NO: 1284 - RNA, 59 nt, Human papillomavirus
aucaucaaaaguacagguuaacauuguguauaguuauucuuguguuuguaaaauauauu

SEQ ID NO: 1285 - RNA, 58 nt, Human papillomavirus
guuuuugcaugagcuuaauuaaguuuuuagggggcacaguaauuaguuauguaaauuc

SEQ ID NO: 1286 - RNA, 55 nt, Human respiratory syncytial virus
ucagauauuuuaugugccaauauuaaauuagaauuaacaugagauccagauuuga

SEQ ID NO: 1287 - RNA, 64 nt, Human respiratory syncytial virus
aacuuauuugaguacuagaucugauaaacaaugacuugggaugaucugggacuucagauaaguu

SEQ ID NO: 1288 - RNA, 55 nt, Human respiratory syncytial virus
cauguuauuaaucacagaagaugcuaaucauaaauucacuggguuaauagguaug

SEQ ID NO: 1289 - RNA, 56 nt, Human respiratory syncytial virus
gagauuagaaguauaaaauucaucauugaauuuguguuuauuuuuaauguguauuc

SEQ ID NO: 1290 - RNA, 69 nt, Human respiratory syncytial virus
augcaguauuaauuccuuuuuuuguuauaggguaacaaagaaaggguaucaaacuuuuaauauuugcau

SEQ ID NO: 1291 - RNA, 58 nt, Human respiratory syncytial virus
agcucuucauugucccucagcuuuuugauaucaucacuauugaguucagugaggaguu

SEQ ID NO: 1292 - RNA, 67 nt, Human respiratory syncytial virus
uaugauugcaguuguuggugugacuuugugguuugccgaggcuaugaauaugauggcugcaauuaua

SEQ ID NO: 1293 - RNA, 80 nt, Human respiratory syncytial virus
ugauauccuaguucauuguuaugacuauuuuuaauuaacuacuuuauaguauggauagugguuugcauggugggauguua

SEQ ID NO: 1294 - RNA, 55 nt, Human respiratory syncytial virus
auccugaguaagggaugauuuuugcauuugugauagcauuuuugaauucaguggu

SEQ ID NO: 1295 - RNA, 55 nt, Human respiratory syncytial virus
agacccuaaagcuugaggaucucucaucaauguuacgaauucagcauuaggguuu

SEQ ID NO: 1296 - RNA, 55 nt, Human respiratory syncytial virus
aacgauguggugaguguuagaauugaguguuaugacacuaauauauauauuguau

SEQ ID NO: 1297 - RNA, 56 nt, Human respiratory syncytial virus
auauacaccguuauguugaauuguuuuacucauaaauugcauaucucgugauauau

SEQ ID NO: 1298 - RNA, 55 nt, Human respiratory syncytial virus
cauauuuuuugauuuuaggcauguuagacuacaugccuugauuucacagggugug

SEQ ID NO: 1299 - RNA, 55 nt, Human respiratory syncytial virus
aacuuacagaaagagauuugauuguguuaucaggacuacguuucuaucgugaguu

SEQ ID NO: 1300 - RNA, 89 nt, Human respiratory syncytial virus
uggguuuacauugauagauaaucaaacucuuaguggauuucaauuuauuuugaaccaauaugguuguauaguuuaucauaaggaacuca

SEQ ID NO: 1301 - RNA, 122 nt, Human respiratory syncytial virus
gcaucauauagaucuugauuccucgguguaccucuguacucucccauuaugccuaggccagcagcauugccuaauacuacacuggagaagugaggaaauugagucaaagauaauaaugaugc

SEQ ID NO: 1302 - RNA, 56 nt, Human respiratory syncytial virus
uagguguuggaucugcaaucgccaguggcguugcuguaucuaagguccugcaccua

SEQ ID NO: 1303 - RNA, 56 nt, Human respiratory syncytial virus
cagaauuugcuugagaauucuauuguuauggauguauuuuccauugguugauucug

SEQ ID NO: 1304 - RNA, 56 nt, Human respiratory syncytial virus
uuggaacucuaucacaguugcuauauuugauaugcugcagcuuugcuuguucacaa

SEQ ID NO: 1305 - RNA, 56 nt, Human respiratory syncytial virus
uaggugcaggaccuuagauacagcaacgccacuggcgauugcagauccaacaccua

SEQ ID NO: 1306 - RNA, 56 nt, Human respiratory syncytial virus
auauaggagaucauauuguagaucuuaacaauguagaugaacaaaguggauuauau

SEQ ID NO: 1307 - RNA, 57 nt, Human respiratory syncytial virus
aguuuaucuuuuaagucaugguuuguauaauaacuaaguaugaacacagagugaacu

SEQ ID NO: 1308 - RNA, 55 nt, Human respiratory syncytial virus
ugcaguuguuggugugacuuugugguuugccgaggcuaugaauaugauggcugca

SEQ ID NO: 1309 - RNA, 95 nt, Human respiratory syncytial virus
guuuaacauuaccaagugaaguaaaucucugcaauguugacauauucaaccccaaauaugauuguaaaauuaugacuucaaaaacagauguaagc

SEQ ID NO: 1310 - RNA, 77 nt, Human respiratory syncytial virus
guccaacagcaauuaaugauaacaauauuacuauaaucacuauaauuauaguaguuaucaugauauuuaugguggau

SEQ ID NO: 1311 - RNA, 55 nt, Human respiratory syncytial virus
auuggcacauaaaauaucugacuauuuucauaauacuuacauuuuaaguacuaau

SEQ ID NO: 1312 - RNA, 122 nt, Human respiratory syncytial virus
gaucuuuauucauuauucauuaugaaaguuguauaacagacuaccugugauuuuaaucaguuuuuuaaguucauugguugucaagcuguuuaacaauucacuuagguaaggauauguagauu

SEQ ID NO: 1313 - RNA, 55 nt, Human respiratory syncytial virus
uuaguuuguuggucuucuguugguauuguguguugaugugaagauugguaacuaa

SEQ ID NO: 1314 - RNA, 56 nt, Human respiratory syncytial virus
cauuauauuucucuauaauuaugccacuagauauagugcuuguaguauauuugaug

SEQ ID NO: 1315 - RNA, 56 nt, Human respiratory syncytial virus
uuuucucugcuuuauaaaaggguaaacuuucauaaacaacucuuagcccaugagga

SEQ ID NO: 1316 - RNA, 75 nt, Human respiratory syncytial virus
gcaaauaaucugcuagagcaugaguuugaccuuccaugagucugauugguuugcuuauaucuauugauugauugu

SEQ ID NO: 1317 - RNA, 56 nt, Human respiratory syncytial virus
agcaaauucaaucaagcauuucgauaugaaacgucauguauuuguagugaugugcu

SEQ ID NO: 1318 - RNA, 75 nt, Human respiratory syncytial virus
uccaccauaaauaucaugauaacuacuauaauuauagugauuauaguaauauuguuaucauuaauugcuguugga

SEQ ID NO: 1319 - RNA, 55 nt, Human respiratory syncytial virus
aacucacgauagaaacguaguccugauaacacaaucaaaucucuuucuguaaguu

SEQ ID NO: 1320 - RNA, 55 nt, Human respiratory syncytial virus
auuugaagcuaugacauccuuuuacucuauguaaacuugcaucuuggcuaagaau

SEQ ID NO: 1321 - RNA, 56 nt, Human respiratory syncytial virus
ugcuuagugugacuggugugcuucuggccuuacaguauaagagcaguccaacagca

SEQ ID NO: 1322 - RNA, 75 nt, Human respiratory syncytial virus
gucauggcuuuuugugauaauauguuuuuaaguaacuacuggcgugguguguuggguggagaugaagguugugau

SEQ ID NO: 1323 - RNA, 90 nt, Human respiratory syncytial virus
gaguuguuguuguguuuuuggucuugacuguuguggauugcaggguugacuugacuccugguguuguugaagcuaguaugguggugauuu

SEQ ID NO: 1324 - RNA, 55 nt, Human respiratory syncytial virus
cauauuuuguguuguauucaguauauuuuuuauauuuagugcuuccuacuuugug

SEQ ID NO: 1325 - RNA, 55 nt, Human respiratory syncytial virus
auuaguacuuaaaauguaaguauuaugaaaauagucagauauuuuaugugccaau

SEQ ID NO: 1326 - RNA, 55 nt, Human respiratory syncytial virus
cauagaguaaaaggaugucauagcuucaaauuaugguuucuuaaacgucuuaaug

SEQ ID NO: 1327 - RNA, 56 nt, Human respiratory syncytial virus
ucuaugucuaagguauuuuuagaacaaaaaguuaucaaauacauucuuagccaaga

SEQ ID NO: 1328 - RNA, 55 nt, Human respiratory syncytial virus
ucuaauauuuuuuguaguucuagaucaccauaucuuguaagacuuucaggaaaga

SEQ ID NO: 1329 - RNA, 56 nt, Human respiratory syncytial virus
guccagcuauagaauaugauaguauaucuccacuaacaacacucuuuaguuuugac

SEQ ID NO: 1330 - RNA, 58 nt, Human respiratory syncytial virus
ugaccucgaauuucaaauuugcaaggauuccuucgugacauauuugccccaguuuuca

SEQ ID NO: 1331 - RNA, 55 nt, Human respiratory syncytial virus
ugucuaauuugaaaucaauaucaucuugagcaugauauuuuacuauuaacauaca

SEQ ID NO: 1332 - RNA, 55 nt, Human respiratory syncytial virus
acaggugauguugauauucacaaguuaaaacaagugauacaaaaacagcauaugu

SEQ ID NO: 1333 - RNA, 56 nt, Human respiratory syncytial virus
aaaugauaacuuuaggauuaguucacuaaaaguuauuuaaaaaauuauaugauuuu

SEQ ID NO: 1334 - RNA, 60 nt, Human respiratory syncytial virus
aagugcucuacuauccacaaacaaggcuguagucagcuuaucaaauggaguuagugucuu

SEQ ID NO: 1335 - RNA, 55 nt, Human respiratory syncytial virus
acauaugcuguuuuuguaucacuuguuuuaacuugugaauaucaacaucaccugu

SEQ ID NO: 1336 - RNA, 56 nt, Human respiratory syncytial virus
auguugauuugaauuucaguuguuaagcuugccaauguuaacacuucaaauuucau

SEQ ID NO: 1337 - RNA, 56 nt, Human respiratory syncytial virus
auguuuucaaauucacauaaagcaauaauaucauguguaggguugagugucuucau

SEQ ID NO: 1338 - RNA, 55 nt, Human respiratory syncytial virus
gauuuuugucugcuuuaagaugagauugauuaucuuuaacagcugaaaguauauc

SEQ ID NO: 1339 - RNA, 56 nt, Human respiratory syncytial virus
guagaccaugugaauucccugcaucaauaccagcuuauagaacaacaaauuaucac

SEQ ID NO: 1340 - RNA, 55 nt, Human respiratory syncytial virus
caauuauaguuauuaaaaauuaaaaaucauauaauuuuuuaaauaacuuuuagug

SEQ ID NO: 1341 - RNA, 55 nt, Human respiratory syncytial virus
cacuaaaaguuauuuaaaaaauuauaugauuuuuaauuuuuaauaacuauaauug

SEQ ID NO: 1342 - RNA, 55 nt, Human respiratory syncytial virus
cuugcuguuauauuaucguuugucugaucauuuauuucuucguaugaauagcugg

SEQ ID NO: 1343 - RNA, 60 nt, Human respiratory syncytial virus
cuuuuuucuugggaucuuugggugaugugaauuugcccuuuauugauucuaggaauuuag

SEQ ID NO: 1344 - RNA, 56 nt, Human respiratory syncytial virus
uauuguauagguaaaaauguugacucaauaauguuaccauuguuaucuaauaagaa

SEQ ID NO: 1345 - RNA, 58 nt, Human respiratory syncytial virus
gaaaauaguaaaucuuauaucagguacaaaaucuauaacuaacauacuggaaaaaacu

SEQ ID NO: 1346 - RNA, 65 nt, Human respiratory syncytial virus
gaaccaaaaauuucaucaugccuaagaaagcugauaaagagucuauugaugcaaauauuaaaagu

SEQ ID NO: 1347 - RNA, 60 nt, Human respiratory syncytial virus
uacauaaugcaugauuuuuuaauuguagagcaaucugauuauauaaccauacauuucuaa

SEQ ID NO: 1348 - RNA, 64 nt, Human respiratory syncytial virus
aacuuuacauguuucagcuugugggaagaaagauacugauccugcauugucacaguaccauccu

SEQ ID NO: 1349 - RNA, 57 nt, Human respiratory syncytial virus
gcaucgaaggguggugucaaaaacuauggaccauagaagcuauaucacuauuggauc

SEQ ID NO: 1350 - RNA, 57 nt, Human respiratory syncytial virus
acaauaaucucuuugcuaaucauaaucuccaucaugauugcaauacuaaacaaacuu

SEQ ID NO: 1351 - RNA, 57 nt, Human respiratory syncytial virus
gcuauguguugacucgagcucuugguaacucaaagguuuuguuauggaauacguuau

SEQ ID NO: 1352 - RNA, 58 nt, Human respiratory syncytial virus
aggcuccaucuggacuauggaguauaguuaugcauagaguuguuguuuuagauugugu

SEQ ID NO: 1353 - RNA, 57 nt, Human respiratory syncytial virus
agagggacugauuccaagcugaggauucugggugagguauguugggguuguguucuu

SEQ ID NO: 1354 - RNA, 63 nt, Human respiratory syncytial virus
ggaaaagaaaugaaauuugaaguguuaacauuggcaagcuuaacaacugaaauucaaaucaac

SEQ ID NO: 1355 - RNA, 55 nt, Human respiratory syncytial virus
gggaauuuaguguuaaugcagguguaacuacaccuguaagcacuuacauguuaac

SEQ ID NO: 1356 - RNA, 56 nt, Human respiratory syncytial virus
auauuaauuauaauuuauggauuaagaucaaauccaaguaauucagauaauugauu

SEQ ID NO: 1357 - RNA, 56 nt, Human respiratory syncytial virus
gugcucuacuauccacaaacaaggcuguagucagcuuaucaaauggaguuaguguc

SEQ ID NO: 1358 - RNA, 60 nt, Human respiratory syncytial virus
auacuacaaggauauuugucagguaguaucauuauuuuuggcauggucauuuguaucacu

SEQ ID NO: 1359 - RNA, 66 nt, Human respiratory syncytial virus
guaguuggagugcuagagaguuauauaggaucaauaaacaauauaacuaaacaaucagcauguguu

SEQ ID NO: 1360 - RNA, 60 nt, Human respiratory syncytial virus
uugagagguccaauggauuucauugaauguuugauucggugaguacauaugguuauuugg

SEQ ID NO: 1361 - RNA, 57 nt, Human respiratory syncytial virus
cugcuagagcaugaguuugaccuuccaugagucugauugguuugcuuauaucuauug

SEQ ID NO: 1362 - RNA, 59 nt, Human respiratory syncytial virus
cuguacucucccauuaugccuaggccagcagcauugccuaauacuacacuggagaagug

SEQ ID NO: 1363 - RNA, 61 nt, Human respiratory syncytial virus
auguugaauuguuuuacucauaaauugcauaucucgugauauauaagucucaguuccuuuu

SEQ ID NO: 1364 - RNA, 57 nt, Human respiratory syncytial virus
cuucaaagugaaaaucauuauuggguuugcuuggugguuuguuuuggcguuguuuug

SEQ ID NO: 1365 - RNA, 57 nt, Human respiratory syncytial virus
uuuuucugaucauuuguuauaggcauaucauugauuaaugacaauaauucacuauua

SEQ ID NO: 1366 - RNA, 55 nt, Influenza A virus
agugaaaaugaauccaaaucaaaagauaauaacgauuggcucuguuucucucacu

SEQ ID NO: 1367 - RNA, 56 nt, Influenza A virus
gccaguugcaugggccucauauacaauaggaugggggcuguaaccaccgaaguggc

SEQ ID NO: 1368 - RNA, 82 nt, Influenza A virus
ugugucaugcgauccugacaaguguuaucaauuugcccuuggacagggaacaacacuaaacaacaggcauucaaaugacaca

SEQ ID NO: 1369 - RNA, 63 nt, Influenza A virus
cuuacuccaaaacagaaacggaaaauggcgagaacagcuaggucaaaaguuugaagagauaag

SEQ ID NO: 1370 - RNA, 64 nt, Influenza A virus
aggccaggcaaauggugcaggcaaugagaaccguugggacucauccuagcuccaguacuggucu

SEQ ID NO: 1371 - RNA, 56 nt, Influenza A virus
caguacuggagcuaggaugagucccaacgguucucauugccugcaccauuugccug

SEQ ID NO: 1372 - RNA, 55 nt, Influenza A virus
guuagguuuggaccagccuucaaugaccuugaagguuucauaaccugagcgugac

SEQ ID NO: 1373 - RNA, 55 nt, Influenza A virus
aagcuagcaguugcauuuucaucaugcccaguuacacaaacaugcagccaugcuu

SEQ ID NO: 1374 - RNA, 129 nt, Influenza A virus
ggguucgauaagggguccuaucauguacugugucauuugaaugccuguuguuuaguguuguucccuguccaagggcaaauugauaacacuugucaggaucgcaugacacauaagguucucuugucaccc

SEQ ID NO: 1375 - RNA, 55 nt, Influenza A virus
gcccagccuuucacuccaugacccccuucuucauuguuaggauccaggcaauggc

SEQ ID NO: 1376 - RNA, 55 nt, Influenza A virus
aaacaaugcuauaauccuuuacauuuauaucuacgaugggccuauuggagccuuu

SEQ ID NO: 1377 - RNA, 67 nt, Influenza A virus
cgccauuuuccguuucuguuuuggaguaaguggaggucccccauucucauuacugcuucuccaagcg

SEQ ID NO: 1378 - RNA, 55 nt, Influenza A virus
agcccuuaguaauacuauggucucuagucggccaaagaucacacugaaauucgcu

SEQ ID NO: 1379 - RNA, 56 nt, Influenza A virus
caggcaaauggugcaggcaaugagaaccguugggacucauccuagcuccaguacug

SEQ ID NO: 1380 - RNA, 57 nt, Influenza A virus
ccaggagucggaaugcguuuguaucaauggaacuuguacaguaguaaugacugaugg

SEQ ID NO: 1381 - RNA, 69 nt, Influenza A virus
caauagugagagaaacagagccaaucguuauuaucuuuugauuuggauucauuuucacuccugcuuuug

SEQ ID NO: 1382 - RNA, 55 nt, Influenza A virus
caggagucggaaugcguuuguaucaauggaacuuguacaguaguaaugacugaug

SEQ ID NO: 1383 - RNA, 56 nt, Influenza A virus
aagaucccaaugauacucgcagcaacaacaagcgggucacuugaaucguugcaucu

SEQ ID NO: 1384 - RNA, 56 nt, Influenza A virus
caucguagauauaaauguaaaggauuauagcauuguuuccaguuaugugugcucag

SEQ ID NO: 1385 - RNA, 58 nt, Influenza A virus
gcacuccucgacaugcugagcacuuccugacaauuugcuaguaugaacgauuuucccc

SEQ ID NO: 1386 - RNA, 58 nt, Influenza A virus
cugccaugacaguugacuuuucaaaugggagguuucuuuguacagaaaacguagguug

SEQ ID NO: 1387 - RNA, 60 nt, Influenza A virus
auccugacaaguguuaucaauuugcccuuggacagggaacaacacuaaacaacaggcauu

SEQ ID NO: 1388 - RNA, 62 nt, Influenza A virus
cgauucauuagcugugagaccauucgaucuaaaaacuucuaugguguuggcuaaugcaguug

SEQ ID NO: 1389 - RNA, 83 nt, Influenza A virus
ugugccacagcacacaaauuggcgggacaaggaugguggacauucuuaggcagaacccgacugaagaacaagcuguggauaua

SEQ ID NO: 1390 - RNA, 65 nt, Influenza A virus
guccaccauccuugucccgccaauuugugugcuguggcacaucuccaauaaagaugcuaguggau

SEQ ID NO: 1391 - RNA, 45 nt, Influenza A virus
ucucgaacauguauccuuuuccuagucuugccauuuuguuugaga

SEQ ID NO: 1392 - RNA, 99 nt, Influenza A virus
ugccuugaaacaauggaagucguucaacaaacaaggguggacaaacuaacucaaggucgccagacuuaugauuggacauuaaacagaaaucaaccggca

SEQ ID NO: 1393 - RNA, 56 nt, Influenza A virus
gcauuagccaacaccauagaaguuuuuagaucgaauggucucacagcuaaugaauc

SEQ ID NO: 1394 - RNA, 125 nt, Influenza A virus
auuauuggugcgaugcucaggauguuucugaaccacucagguugauuuuuugugauauauguaaucaucgccaagaacauucgaggguuuugauuuucauuccacuuaguguuguccccagugau

SEQ ID NO: 1395 - RNA, 74 nt, Influenza A virus
ccacagcacacaaauuggcgggacaaggaugguggacauucuuaggcagaacccgacugaagaacaagcugugg

SEQ ID NO: 1396 - RNA, 59 nt, Influenza A virus
gauguugaccaaagccuaauuauugcagccaggaacauaguaagaagagccgcaguauc

SEQ ID NO: 1397 - RNA, 112 nt, Influenza A virus
gaugaugacuaauucacaagacacagagcuuucuuucacaaucacuggggacaacacuaaguggaaugaaaaucaaaacccucgaauguucuuggcgaugauuacauauauc

SEQ ID NO: 1398 - RNA, 51 nt, Influenza A virus
cauuagccaacaccauagaaguuuuuagaucgaauggucucacagcuaaug

SEQ ID NO: 1399 - RNA, 74 nt, Influenza A virus
ccacagcuuguucuucagucggguucugccuaagaauguccaccauccuugucccgccaauuugugugcugugg

SEQ ID NO: 1400 - RNA, 93 nt, Influenza A virus
ccuugaguuaguuuguccacccuuguuuguugaacgacuuccauuguuucaaggcaugaguucucaaagaucccugggugggauucuucaagg

SEQ ID NO: 1401 - RNA, 129 nt, Influenza A virus
auucgaucuaaaaacuucuaugguguuggcuaaugcaguugcugccgguugauuucuguuuaauguccaaucauaagucuggcgaccuugaguuaguuuguccacccuuguuuguugaacgacuuccau

SEQ ID NO: 1402 - RNA, 103 nt, Influenza A virus
uuugcacucaaaugcaaauguugcaccuaauguugccuuuuuggcaggcccacaugaugaaccccagcaaaacaacacaaagcaaaaagcaugauauggcaaa

SEQ ID NO: 1403 - RNA, 103 nt, Influenza A virus
uuugccauaucaugcuuuuugcuuuguguuguuuugcugggguucaucaugugggccugccaaaaaggcaacauuaggugcaacauuugcauuugagugcaaa

SEQ ID NO: 1404 - RNA, 113 nt, Influenza A virus
cuccagguggagaagugaggaaugacgauguugaccaaagccuaauuauugcagccaggaacauaguaagaagagccgcaguaucagcagauccacuagcaucuuuauuggag

SEQ ID NO: 1405 - RNA, 53 nt, Influenza A virus
aagcaugauauggcaaaggaaauccauaggauccaaucuuuguauccugacuu

SEQ ID NO: 1406 - RNA, 57 nt, Influenza A virus
acauaguaagaagagccgcaguaucagcagauccacuagcaucuuuauuggagaugu

SEQ ID NO: 1407 - RNA, 98 nt, Influenza A virus
ccagaucaaagguguugagcugaagucaggauacaaagauuggauccuauggauuuccuuugccauaucaugcuuuuugcuuuguguuguuuugcugg

SEQ ID NO: 1408 - RNA, 49 nt, Influenza A virus
guugcaccuaauguugccuuuuuggcaggcccacaugaugaaccccagc

SEQ ID NO: 1409 - RNA, 82 nt, Influenza A virus
uugccauaucaugcuuuuugcuuuguguuguuuugcugggguucaucaugugggccugccaaaaaggcaacauuaggugcaa

SEQ ID NO: 1410 - RNA, 90 nt, Influenza A virus
cacuggggacaacacuaaguggaaugaaaaucaaaacccucgaauguucuuggcgaugauuacauauaucacaaaaaaucaaccugagug

SEQ ID NO: 1411 - RNA, 99 nt, Influenza A virus
ugccgguugauuucuguuuaauguccaaucauaagucuggcgaccuugaguuaguuuguccacccuuguuuguugaacgacuuccauuguuucaaggca

SEQ ID NO: 1412 - RNA, 110 nt, Influenza A virus
aaccgguuccagaucaaagguguugagcugaagucaggauacaaagauuggauccuauggauuuccuuugccauaucaugcuuuuugcuuuguguuguuuugcugggguu

SEQ ID NO: 1413 - RNA, 58 nt, Influenza A virus
ccgguuccagaucaaagguguugagcugaagucaggauacaaagauuggauccuaugg

SEQ ID NO: 1414 - RNA, 59 nt, Influenza A virus
gguguugagcugaagucaggauacaaagauuggauccuauggauuuccuuugccauauc

SEQ ID NO: 1415 - RNA, 58 nt, Influenza A virus
ucgcaccaauaauguucucaaacaaaauggcaagacuaggaaaaggauacauguucga

SEQ ID NO: 1416 - RNA, 53 nt, Influenza A virus
gcccacaugaugaaccccagcaaaacaacacaaagcaaaaagcaugauauggc

SEQ ID NO: 1417 - RNA, 48 nt, Influenza A virus
gccuaagaauguccaccauccuugucccgccaauuugugugcuguggc

SEQ ID NO: 1418 - RNA, 55 nt, Influenza A virus
caguugcugccgguugauuucuguuuaauguccaaucauaagucuggcgaccuug

SEQ ID NO: 1419 - RNA, 70 nt, Influenza A virus
ugcuuuuugcuuuguguuguuuugcugggguucaucaugugggccugccaaaaaggcaacauuaggugca

SEQ ID NO: 1420 - RNA, 55 nt, Influenza A virus
ccacucagguugauuuuuugugauauauguaaucaucgccaagaacauucgaggg

SEQ ID NO: 1421 - RNA, 65 nt, Influenza A virus
ugaggaaugacgauguugaccaaagccuaauuauugcagccaggaacauaguaagaagagccgca

SEQ ID NO: 1422 - RNA, 70 nt, Influenza A virus
gcaacugcauuagccaacaccauagaaguuuuuagaucgaauggucucacagcuaaugaaucgggaaggc

SEQ ID NO: 1423 - RNA, 49 nt, Influenza A virus
gccuaauuauugcagccaggaacauaguaagaagagccgcaguaucagc

SEQ ID NO: 1424 - RNA, 55 nt, Influenza A virus
uuuguguuguuuugcugggguucaucaugugggccugccaaaaaggcaacauuag

SEQ ID NO: 1425 - RNA, 51 nt, Influenza A virus
gguuccagaucaaagguguugagcugaagucaggauacaaagauuggaucc

SEQ ID NO: 1426 - RNA, 69 nt, Influenza A virus
uaacuggaaacaaugcuauaauccuuuauguuuauaucuacgaugggccuauuggagccuuuccaguug

SEQ ID NO: 1427 - RNA, 86 nt, Influenza A virus
uggaguauucauccacacccauuuugcugacucuuauuccucucauugacaucucugugcuuggagucauaucugguaauacucca

SEQ ID NO: 1428 - RNA, 66 nt, Influenza A virus
gcugaaggaugagcugauucucaaucccauugcagccuugcauauauccacagcuuguucuucagu

SEQ ID NO: 1429 - RNA, 55 nt, Influenza A virus
uaauucagguucgucacuaucauauugcuucaaaucgcuuaugucucugcaguug

SEQ ID NO: 1430 - RNA, 125 nt, Influenza A virus
auuauuggugcgaugcucaggauguuucugaaccacucagguugauuuuuugugauauauguaaucaucgccaaaaacauucgaggguuuugauuuucauuccacuuaguguuguccccagugau

SEQ ID NO: 1431 - RNA, 55 nt, Influenza A virus
caauuggagagccaucugggcuguugcuggcccaaggucauuguuuaucauguug

SEQ ID NO: 1432 - RNA, 55 nt, Influenza A virus
ugucuuuagccauuccaugagagccucaagaucuguguuuuucccagcaaagaca

SEQ ID NO: 1433 - RNA, 200 nt, Influenza A virus
gauugccuguaagcacuucuuccucuuuuuugacugaugacccgcuuguucuuuuaaauguaaacccaccaaagcugaaggaugagcugauucucaaucccauugcagccuugcauauauccacagcuuguucuucagucggguucugucuaagaauguccaccauccuugucccgccaauuugugugcuguggcacauc

SEQ ID NO: 1434 - RNA, 74 nt, Influenza A virus
gguagaaacuuugguuuuucugcuccaguaguguugcagauacuguuuacuacuguccaggccauuguucuguc

SEQ ID NO: 1435 - RNA, 55 nt, Influenza A virus
aguugcaacggcaucauauuccauacuuuuggcuggaccgugggcuggcaucacu

SEQ ID NO: 1436 - RNA, 56 nt, Influenza A virus
gaguguuuugcuuaacauaucugggacaggccccauaugugauccuguuuacauuu

SEQ ID NO: 1437 - RNA, 55 nt, Influenza A virus
gcuucaucagagggacaaaaguaucuccgcgggggaaacugucaacuagaggagu

SEQ ID NO: 1438 - RNA, 56 nt, Influenza A virus
gucaaagucuacuuucucuggugccauguuuucaccaagagcccacuuuaguugac

SEQ ID NO: 1439 - RNA, 55 nt, Influenza A virus
uucaaauuaccugcugucauggaagcaaguauugucagaauugcaggacauugaa

SEQ ID NO: 1440 - RNA, 61 nt, Influenza A virus
cugguccauucugaugcaaagagguccuuccacuuucugcuugggcauuagcaugaaccag

SEQ ID NO: 1441 - RNA, 56 nt, Influenza A virus
ugguuugacuauauaagguucuuuccauccaaagaauguuuuuaugcacuugaucg

SEQ ID NO: 1442 - RNA, 56 nt, Influenza A virus
ucuuguuguucaggcucuuagggacaaccucgaaccugggaccuuugaucucgggg

SEQ ID NO: 1443 - RNA, 65 nt, Influenza A virus
aaugcuucaucucuguauacaucauggucauaaguuccauuucugauugacccuaugcaggcauu

SEQ ID NO: 1444 - RNA, 74 nt, Influenza A virus
ucucguuuguuuucccgaucaaccuauucagcuucccauugauuugguugauugcugcuugagugcuuuugaga

SEQ ID NO: 1445 - RNA, 56 nt, Influenza A virus
ggcgauccccaucaguuuccaucuguucauaagaccguuuggugccuugggacgcc

SEQ ID NO: 1446 - RNA, 99 nt, Influenza A virus
cuggaaaggcuccaauaggcccaucguagauauaaacauaaaggauuauagcauuguuuccaguuaugugugcucagggcuuguuggagacacacccag

SEQ ID NO: 1447 - RNA, 55 nt, Influenza A virus
ccagaucauuaugugaguuagaccagcugucgcauccucaccauuguuggcuugg

SEQ ID NO: 1448 - RNA, 59 nt, Influenza A virus
cccaggagucagaaugcguuuguaucaauggaacuuguacaguaguaaugacugauggg

SEQ ID NO: 1449 - RNA, 168 nt, Influenza A virus
gccuuccugauucauuggcuguuaguccauucgaucuaaaaacuucuaugguguuggcuaaugcaguugcugccgguugauuucuguuuaauguccaaucauaagucuggcggccuuggguuaguuuguccacccuuguuuguugaacgacuuccauuguuucaaggc

SEQ ID NO: 1450 - RNA, 55 nt, Influenza A virus
ucaaggccuauguucuuguaugugaggacaaacggaacaucaaaggucaaaauga

SEQ ID NO: 1451 - RNA, 119 nt, Influenza A virus
gacagaacccgacugaagaacaagcuguggauauaugcaaggcugcaaugggauugagaaucagcucauccuucagcuuugguggguuuacauuuaaaagaacaagcgggucaucaguc

SEQ ID NO: 1452 - RNA, 65 nt, Influenza A virus
agaagauugguucagcucauagugaguggaagagacgaacagucaauagccgaagcaauaaucgu

SEQ ID NO: 1453 - RNA, 55 nt, Influenza A virus
aaacaaugcuauaauccuuuauguuuauaucuacgaugggccuauuggagccuuu

SEQ ID NO: 1454 - RNA, 56 nt, Influenza A virus
auugucccgauuccuuugacugcagcaccugcagcuccggaccuucuagggagagu

SEQ ID NO: 1455 - RNA, 95 nt, Influenza A virus
ugcgucuaucgacucuucaaacacggccuuaaaagaggcccuucuacggaaggaguaccugagucuaugagggaagaauaucgaaaggaacagca

SEQ ID NO: 1456 - RNA, 56 nt, Influenza A virus
agggcaggacuauugguaucagaugggggaccaaacuuauacaauauccggaaccu

SEQ ID NO: 1457 - RNA, 56 nt, Influenza A virus
caggcaaauggugcaggcaaugagagccguugggacucauccuagcuccaguacug

SEQ ID NO: 1458 - RNA, 55 nt, Influenza A virus
auacuuacugacagccagacagcgaccaaaagaauucggauggccaucaauuaau

SEQ ID NO: 1459 - RNA, 56 nt, Influenza A virus
ugagagggucaguugcucacaaaucuugccuaccugccugugcguauggaccugca

SEQ ID NO: 1460 - RNA, 56 nt, Influenza A virus
ugccggcacuuuaauugaagacccagaugaaagcacauccggaguggaguccgccg

SEQ ID NO: 1461 - RNA, 56 nt, Influenza A virus
aucgccaaaaacauucgaggguuuugauuuucauuccacuuaguguuguccccagu

SEQ ID NO: 1462 - RNA, 55 nt, Influenza A virus
uuuguguugcuuuguugggguucaucaugugggccugccaaaaaggcaacauuag

SEQ ID NO: 1463 - RNA, 55 nt, Influenza A virus
auuaauugauggccauccgaauucuuuuggucgcugucuggcugucaguaaguau

SEQ ID NO: 1464 - RNA, 55 nt, Influenza A virus
uguacaguuugucaaauuuuucauuguuuggcauagucacguucaaugcugggua

SEQ ID NO: 1465 - RNA, 56 nt, Influenza A virus
gauaauucucauccauuagcucccacuuuaagcagacuucagggaugugaagguuc

SEQ ID NO: 1466 - RNA, 55 nt, Influenza A virus
caucagucauuacuacuguacaaguuccauugauacaaacgcauucugacuccug

SEQ ID NO: 1467 - RNA, 55 nt, Influenza A virus
caucucugugcuuggagucauaucugguaauacuccaaccauucccaucacacug

SEQ ID NO: 1468 - RNA, 56 nt, Influenza A virus
aagaucccaaugauacucgcggcaacaacaagcgggucacuugaaucguugcaucu

SEQ ID NO: 1469 - RNA, 55 nt, Influenza A virus
uauaugcaaggcugcaaugggauugagaaucagcucauccuucagcuuugguggg

SEQ ID NO: 1470 - RNA, 57 nt, Influenza A virus
aaaccgggagacauacuuuugauuaacagcacagggaaucuaauugcuccucggggu

SEQ ID NO: 1471 - RNA, 58 nt, Influenza A virus
uagacgguugguacgguuucaggcaucaaaauucugagggaacaggacaagcagcaga

SEQ ID NO: 1472 - RNA, 63 nt, Influenza A virus
aagugagcaggcagcggaggccauggaaauugcuagucaggccaggcaaauggugcaggcaau

SEQ ID NO: 1473 - RNA, 58 nt, Influenza A virus
aaugacguguggaugggaagaacgaucagcgagaaguuacgcucaggauaugaaaccu

SEQ ID NO: 1474 - RNA, 57 nt, Influenza A virus
ccugcgagcuaacugauucaaucuggauagagcucgaugaaauuggagaggacguag

SEQ ID NO: 1475 - RNA, 57 nt, Influenza A virus
cccucuuuugauaugaguaaugaaggaucuuauuucuucggagacaaugcagaagag

SEQ ID NO: 1476 - RNA, 55 nt, Influenza A virus
ucuuugugcagcuguuugaaauuuuccuuuaagaauguugcacauucucucauaa

SEQ ID NO: 1477 - RNA, 57 nt, Influenza A virus
ugagagaaacagagccaaucguuauuaucuuuugauuuggauucaucuuuacuccug

SEQ ID NO: 1478 - RNA, 57 nt, Influenza A virus
agagacugugauucuuccugaugcuugagcauauaggcugauuuggucauuguccgu

SEQ ID NO: 1479 - RNA, 61 nt, Influenza A virus
ugucaggaagugcucagcaugucgaggagugcuccugcuauccucgauauccuggugucag

SEQ ID NO: 1480 - RNA, 61 nt, Influenza A virus
ugucugaaguccuucccuccguauuuccagugaaugcugccaugaugguugacuuuucaaa

SEQ ID NO: 1481 - RNA, 56 nt, Influenza A virus
auacuuuuggguaauggaccguacuugccacggguccauuucuauuccaccauguu

SEQ ID NO: 1482 - RNA, 57 nt, Influenza A virus
guaaagaugaauccaaaucaaaagauaauaacgauuggcucuguuucucucaccauu

SEQ ID NO: 1483 - RNA, 70 nt, Influenza A virus
guacaucuguucauccucaagaauuccccuuuggcuaguguuuagaauagagcgguuccucuugggauuc

SEQ ID NO: 1484 - RNA, 55 nt, Influenza A virus
guauaugggccccccaguuuucuugggaucuuuccccgcgcugggguguucuucc

SEQ ID NO: 1485 - RNA, 58 nt, Influenza A virus
cuccgcugccugcucacuugauccagccauuugcuccauagccuuagcuguagugcug

SEQ ID NO: 1486 - RNA, 55 nt, Influenza A virus
aucugcuggagugacugaaggaggcaacgucucaucuccauuccccauuucauuu

SEQ ID NO: 1487 - RNA, 56 nt, Influenza A virus
auucauugaaauacuucaggucaaugcuugcuagcauuucugcggguauuuguguu

SEQ ID NO: 1488 - RNA, 57 nt, Influenza A virus
guucuuuccauccaaagaauguuuuuaugcacuugaucgcaucauauaauggaaucc

SEQ ID NO: 1489 - RNA, 59 nt, Influenza A virus
cuuuguguugcuuuguugggguucaucaugugggccugccaaaaaggcaacauuaggug

SEQ ID NO: 1490 - RNA, 45 nt, Influenza A virus
guuguuuugcugggguucaucaugugggccugccaaaaaggcaac

SEQ ID NO: 1491 - RNA, 51 nt, Influenza A virus
uguugcaccuaauguugccuuuuuggcaggcccacaugaugaaccccagca

SEQ ID NO: 1492 - RNA, 55 nt, Influenza A virus
gaagucaggauacaaagauuggauccuauggauuuccuuugccauaucaugcuuu

SEQ ID NO: 1493 - RNA, 103 nt, Influenza A virus; identical to SEQ ID NO: 1403

SEQ ID NO: 1494 - RNA, 59 nt, Influenza A virus
gcuuuguguuguuuugcugggguucaucaugugggccugccaaaaaggcaacauuaggu

SEQ ID NO: 1495 - RNA, 64 nt, Influenza A virus
agcaaaaagcaugauauggcaaaggaaauccauaggauccaaucuuuguauccugacuucagcu

SEQ ID NO: 1496 - RNA, 50 nt, Influenza A virus
ccacaugaugaaccccagcaaaacaacacaaagcaaaaagcaugauaugg

SEQ ID NO: 1497 - RNA, 53 nt, Influenza A virus; identical to SEQ ID NO: 1416

SEQ ID NO: 1498 - RNA, 70 nt, Influenza A virus; identical to SEQ ID NO: 1419

SEQ ID NO: 1499 - RNA, 50 nt, Influenza A virus
guugagcugaagucaggauacaaagauuggauccuauggauuuccuuugc

SEQ ID NO: 1500 - RNA, 70 nt, Influenza A virus
uugagcugaagucaggauacaaagauuggauccuauggauuuccuuugccauaucaugcuuuuugcuuug

SEQ ID NO: 1501 - RNA, 77 nt, Vaccinia virus
uaucaagauguguauguuugugaaaauuguggagacauagcagcacaaaucaaggguauuaauacaugucuuagaug

SEQ ID NO: 1502 - RNA, 85 nt, Vaccinia virus
uuuugauuacgauguuauaagaauguaguuaauugauguaugauguuaauguguccucuuuccucuuauaacaucguaaucaaaa

SEQ ID NO: 1503 - RNA, 85 nt, Vaccinia virus; identical to SEQ ID NO: 1502

SEQ ID NO: 1504 - RNA, 56 nt, Vaccinia virus
acgauauuugugaaaaauauuaaaaaaaaauacuuuuuuuauuaaaugacgucgcu

SEQ ID NO: 1505 - RNA, 64 nt, Vaccinia virus
guacacgugucgauucaucaagguauauaaaccuggggaugaggcuaccucgacauacgugugc

SEQ ID NO: 1506 - RNA, 55 nt, Vaccinia virus
auaaaaagaagauauagacacacgauagagucuguauauuucuaaaaguuuuuau

SEQ ID NO: 1507 - RNA, 199 nt, Vaccinia virus
uaacuuuacuauucaggauaugcuuaacauuaugaauaaacuaaauauugucagaacaaauagaaacgagcuauuucaacuccuuacccauguaaagagcacauugaacaaugcuaguguuucugugaaauguacucauccuuuaguacuuauucauucucgagcuaguccuagaaucggugaccaacucaaagaguua

SEQ ID NO: 1508 - RNA, 73 nt, Vaccinia virus
caaacguuuguuaaagucugcuaucggugaccuguuuguugagacgggucaaacaauuuuaacagauguauug

SEQ ID NO: 1509 - RNA, 95 nt, Vaccinia virus
cgcaauauauuucucuauccggaguuaugacaaacgaugguccagacaaucaggcuaucgcuagcuucgaaauuagggaucaguauauuacugcg

SEQ ID NO: 1510 - RNA, 74 nt, Vaccinia virus
guuaauacgucuugcacguaaucuauuauagaugccaagauaucuauauaauuauuuuguaagaugauguuaac

SEQ ID NO: 1511 - RNA, 55 nt, Vaccinia virus
cuucuaaucauauuauuuuugccggauguaauauaugauaaauugauacuggaag

SEQ ID NO: 1512 - RNA, 108 nt, Vaccinia virus
auguguauauaagauagauuuccuauugucuuacucauugcaucguacuauuguuacauauuuugaguaagaugguuuacaaauuagucuuacucuuuuguaucgcau

SEQ ID NO: 1513 - RNA, 87 nt, Vaccinia virus
gaaaagacguggguacuaaaguuggccgucaucuuaccaauugcaauuggaagaauaacgaccugcacuaauaccacauguuuuuuc

SEQ ID NO: 1514 - RNA, 56 nt, Vaccinia virus
ccuaauagcuugcggcagauauguuuucuuauccaaucgcauagcuauaaaauagg

SEQ ID NO: 1515 - RNA, 65 nt, Vaccinia virus
gauaauaggauaagacuaaugcuugaaaauggacguagaacaagacauuuuuuguccuauauauc

SEQ ID NO: 1516 - RNA, 102 nt, Vaccinia virus
uacaaaggagaugauuuaucuaugguauuaagaauucguuuuucgacaucugucaaaaccaauuccuuuuugccuguaucauccaguuuuccauccuuugua

SEQ ID NO: 1517 - RNA, 71 nt, Vaccinia virus
gugugucugaaucgauaacucuauucaucugaaauuggaugaguaggguuaaucgaacgauucaggcacac

SEQ ID NO: 1518 - RNA, 71 nt, Vaccinia virus; identical to SEQ ID NO: 1517

SEQ ID NO: 1519 - RNA, 97 nt, Vaccinia virus
aacugacuugauaaaaauggcuguaaucucuaagguuacguauagucuauaugaucaaaaagagauuaaugcuacagauauuaucauuagucauguu

SEQ ID NO: 1520 - RNA, 91 nt, Vaccinia virus
uuucaggagaugaucucgccguagcuaccauaauaguagaugccucugcuacaguuccuuguucgucgacaucuaucuuugcauucugaaa

SEQ ID NO: 1521 - RNA, 55 nt, Vaccinia virus
aauaauuuuugaugcuguugaaucuuuagauuaucuauuauccagaggaguuauu

SEQ ID NO: 1522 - RNA, 55 nt, Vaccinia virus
uguucauuggaguugauaauaauacacacaaaguaauuggauucacgguggguca

SEQ ID NO: 1523 - RNA, 59 nt, Vaccinia virus
auauauguaaucauuguccagauugaacauacaguuugcacucaugauucacguuauau

SEQ ID NO: 1524 - RNA, 68 nt, Vaccinia virus
cuauugccucuuacuagcuuaguuauuaccuauugcuuaguaacucaaauguaucguggagguaaugg

SEQ ID NO: 1525 - RNA, 77 nt, Vaccinia virus
uaugaacauuagaaugggaauuuuuuauuguaacgaugaugaugcgguagauccccaucuaaugaagauuauucaua

SEQ ID NO: 1526 - RNA, 60 nt, Vaccinia virus
gaccuauauauuuauuuucaguuuuauuauacgcauaaauuguaaaaaauauguuagguu

SEQ ID NO: 1527 - RNA, 120 nt, Vaccinia virus
guaaguauguugaaucuaaacuaguggauauuugugaucggauaguauucaagucaaagaaauacgaagguccguuuacuacaacuagugaagucgucgauauguuaucuacauauuuac

SEQ ID NO: 1528 - RNA, 75 nt, Vaccinia virus
ccauuucugccgcauacaauaacuuguuagauaaaaucaggguuaucaaaguguuuagcguggcuagaauagugg

SEQ ID NO: 1529 - RNA, 120 nt, Vaccinia virus
aaugacauacauacuaucuuuaauagaacucuuuucauccaguugaauggauucguccuuaaccaacugauuaaugagaucuucuauuuuaucauuuuccagaugauauguauguccauu

SEQ ID NO: 1530 - RNA, 68 nt, Vaccinia virus
aguagguaauggccaugggaacaguaauguuugcauauuuaucuuucuugccaguauuacugcauauu

SEQ ID NO: 1531 - RNA, 59 nt, Vaccinia virus
gucuuugguaucucuaauauagaguucucaucuagaacaaaagauacuagaaucaaggc

SEQ ID NO: 1532 - RNA, 55 nt, Vaccinia virus
cuguguuuauagagcccacguuuaaacauucuuuauuaaguguuuauaaacacag

SEQ ID NO: 1533 - RNA, 85 nt, Vaccinia virus
uuaaucaaucguuggaggauuuaucgcauacuaguauuuacaauguagaaauuagaaagauuaaaucauuaaaugauuguauuaa

SEQ ID NO: 1534 - RNA, 56 nt, Vaccinia virus
ucugaaggacggaugaauucuaaucagguauguauagauauucuccguucuuuaga

SEQ ID NO: 1535 - RNA, 55 nt, Vaccinia virus
aaguuauagaauguaucugucacgauguaggaauauagaucauaucuacuaauuu

SEQ ID NO: 1536 - RNA, 93 nt, Vaccinia virus
uacggaugcucgauguacaaauugauauggucgucguauucagucaauguuacagucggugguccaauuuuuacuucgacgcauagucccgua

SEQ ID NO: 1537 - RNA, 62 nt, Vaccinia virus
gauguucguguguucuugcggugauuauaucuuaauuauagcagaugcaaaauacgaauauu

SEQ ID NO: 1538 - RNA, 55 nt, Vaccinia virus
uauaacuaaacagucuaucaucgacacaaaugaaauucuuguuuagacguuugua

SEQ ID NO: 1539 - RNA, 56 nt, Vaccinia virus
auuggucgguguuuggucuugcuuugugacuuugauaauaacaucgauucccauau

SEQ ID NO: 1540 - RNA, 55 nt, Vaccinia virus
ugauauauauguaauggguggaguuuauaccacguaugaaaaauauguaguauua

SEQ ID NO: 1541 - RNA, 55 nt, Vaccinia virus
ucaauaacuggcacaacaauaacaggaguuuucgccgccgccauuuaguuauuga

SEQ ID NO: 1542 - RNA, 59 nt, Vaccinia virus
agucgguuauaaauucuauauaugauggauacaugcuacauguguacuuauaaucgacu

SEQ ID NO: 1543 - RNA, 80 nt, Vaccinia virus
aucucgauaucucaaucauggacuuuauaggaccauacauuauagguaacauaaaaacuguccaaauagauguacgggau

SEQ ID NO: 1544 - RNA, 87 nt, Vaccinia virus
uuguuggugcgcgaauuauccaaaaucuaauuccggagauaaauauuuaggaccuaggguauguugguuacaugagugcaccgacga

SEQ ID NO: 1545 - RNA, 61 nt, Vaccinia virus
uauauugcuguagcgacuguacaucuauaagaguaucauaaucggucauacacgcaguaua

SEQ ID NO: 1546 - RNA, 125 nt, Vaccinia virus
cgcuucuaucuuguuuagauuuauuuuuauaaaguuuagucucuccuuccaacauaauaaaaguggaagucauuugacuagauaaacuaucaguaaguuuuauagagauagacgaacaauuagcg

SEQ ID NO: 1547 - RNA, 58 nt, Vaccinia virus
guaaaauugauguaguggucuccuucgcucauagcuucgacaaucucauuaauuuuau

SEQ ID NO: 1548 - RNA, 56 nt, Vaccinia virus
auuauuuaaaguuaaauggcugcagaacagcgucguucuacaauuuuugacauagu

SEQ ID NO: 1549 - RNA, 61 nt, Vaccinia virus
guugaaaucuaguucugcauuguugguacgcaccucaaauguaguguuggauaucuucaac

SEQ ID NO: 1550 - RNA, 80 nt, Vaccinia virus
auagauaugauaacaggaauaacaucuuuagguuuaaaauaauuauauacaccaguaggagucuugucaucgucaucuau

SEQ ID NO: 1551 - RNA, 75 nt, Vaccinia virus
aguaggcguacaagcagccaaaacaucaacacuuauauucuuuguuauuauauuggcaauuagugcgcuauuacu

SEQ ID NO: 1552 - RNA, 103 nt, Vaccinia virus
gaagaauaucuauaucgccguaccguauauuuggauuaauuagauauagagaauaugauccguaacauauacaacuuuuauuauggcgucuaagauauucuuc

SEQ ID NO: 1553 - RNA, 113 nt, Vaccinia virus
gacauacauaucaucuggaaaaugauaaaauagaagaucucauuaaucaguugguuaaggacgaauccauucaacuggaugaaaagaguucuauuaaagauaguauguauguc

SEQ ID NO: 1554 - RNA, 55 nt, Vaccinia virus
aauauaaucugccguauuggauggauucucaagacaauugcauuuagauuauauu

SEQ ID NO: 1555 - RNA, 73 nt, Vaccinia virus
uuuuugguaaucuauuauuauuggcucugaucaccgcaucuagaucugcaccuaaucuauuaauuaccaagaa

SEQ ID NO: 1556 - RNA, 87 nt, Vaccinia virus
uaaacgguacuguaauaauaucguuuucguauuuguauaaaagagauuuaucaaauacuuuauucgauacaaagaagugaccguuua

SEQ ID NO: 1557 - RNA, 75 nt, Vaccinia virus
uuaagaacuuagucucucaguuugcuuauggauccgaaguggauuauauaggacaauuugacaugagauucuuaa

SEQ ID NO: 1558 - RNA, 96 nt, Vaccinia virus
gaucaucugauuuucuuuauuuguccgauagugacuauacuaguauaaccaaagaaacauuaguuagugagaucguagaagaauauccggaugauu

SEQ ID NO: 1559 - RNA, 75 nt, Vaccinia virus
ugagagaguacugguuucauguuucuacuaaagaaggcaaacucguuauuauuuuuaugaacuuguacucuuuca

SEQ ID NO: 1560 - RNA, 56 nt, Vaccinia virus
agugaaaaaaauguaaauacuuuuuaaauuuuaaauuaguaaaacuuuuuuuuauu

SEQ ID NO: 1561 - RNA, 56 nt, Vaccinia virus; identical to SEQ ID NO: 1560

SEQ ID NO: 1562 - RNA, 60 nt, Vaccinia virus
guuaccgcauuuaucuaacacuauuccauauuacuaaaaucggaacaccaaugcggugac

SEQ ID NO: 1563 - RNA, 83 nt, Vaccinia virus
gcuaugguguacagcuccgacgauauuccuccucguugguuuaugacaacggaggcggauaagccggaugcugaugcuauggc

SEQ ID NO: 1564 - RNA, 82 nt, Vaccinia virus
gugucuaacuaguggagguucgucagcggcucuaguuugaaucaucaucggcguaguauuccuacuuuuacaguuaggacac

SEQ ID NO: 1565 - RNA, 55 nt, Vaccinia virus
gacauggaagagugcuaacuauaguauauaguuuucguuuacacgcuucuauguu

SEQ ID NO: 1566 - RNA, 61 nt, Vaccinia virus
ucacaagcuaagaaaccugaaguacgcauuccuguagaucuuguaaagucuaguuuuguga

SEQ ID NO: 1567 - RNA, 55 nt, Vaccinia virus
aauauaaucuaaaugcaauugucuugagaauccauccaauacggcagauuauauu

SEQ ID NO: 1568 - RNA, 92 nt, Vaccinia virus
ggguauuaauaauaucuauauuuccagcguuaaguguaacauuaaacaguuuuaauucacgugacgugguaucaauuaaauaauuaaugccc

SEQ ID NO: 1569 - RNA, 55 nt, Vaccinia virus
ucauauuuuuaaucuccguuauaguauuaguuuguuccugugacaaaaauaauga

SEQ ID NO: 1570 - RNA, 55 nt, Vaccinia virus
cuaaaaaacgauagcuuuuuauacaauguauauccuggagcgugugacuuuuugg

SEQ ID NO: 1571 - RNA, 90 nt, Vaccinia virus
gaguccauacauuccuaaaaagauaguuucacuauuggauuuaccaucuaauguggaaauaaaggcgauaucuagaggcgguguggauuu

SEQ ID NO: 1572 - RNA, 111 nt, Vaccinia virus
gagauuucggccaucaucggacuuugugcauaugcugcuacuuacuggggaggugaagaccaucccacuaguaacagucugaacgcauuguuugugaugcuugagaugcuc

SEQ ID NO: 1573 - RNA, 62 nt, Vaccinia virus
agacuucuggcgguugccauagaauauacgucguucuuaucccaauuaccaacuagaagucu

SEQ ID NO: 1574 - RNA, 95 nt, Vaccinia virus
gaucuauagucuucguaucuguuacgaaaaucaauauauucaggauuauuuucugaaucacuugauucgucacuaauauacauaacuauaugauc

SEQ ID NO: 1575 - RNA, 56 nt, Vaccinia virus
ugguaacuucgaaaccguuauuuauagcagauauagggauaggaguaggaaugcca

SEQ ID NO: 1576 - RNA, 55 nt, Vaccinia virus
cuucuuuagcgggcuuaaagacugcuuuaggugcugaaauaaccacaucuggaag

SEQ ID NO: 1577 - RNA, 55 nt, Vaccinia virus
gccgaaacucgucauaauuggguuccucaaaauaugucaaagaguuuaccauggu

SEQ ID NO: 1578 - RNA, 91 nt, Vaccinia virus
uuuccuguuuguucaaauaauuggaauaauucagaaauaaucguuucuuucuaaacauguuucuaguucuaauuauuucagaauagagaaa

SEQ ID NO: 1579 - RNA, 56 nt, Vaccinia virus
auaucauuugguucaucuauguauuguaauauuguuacaugaucuauagaugaugu

SEQ ID NO: 1580 - RNA, 61 nt, Vaccinia virus
uuauuaucuuguuccauauuagcagucauuccaucauuuaagaaggcgucaaagauaauag

SEQ ID NO: 1581 - RNA, 142 nt, Vaccinia virus
ugaugcgugauauauaucacagcauaauuuucuaaauucgcgaagcgacgucauuuaauaaaaaaaguauuuuuuuuuaauauuuuucacaaauaucguucgcggauaucauuagacaauuguaguauauucucacguauca

SEQ ID NO: 1582 - RNA, 55 nt, Vaccinia virus
auccuaaauguguauucuccuuccacauccauaagauugaaugccauuuacggau

SEQ ID NO: 1583 - RNA, 55 nt, Vaccinia virus
uuaucgauuuuuaauugcauuucugccuuuauuucuucuuccauaaauccgguaa

SEQ ID NO: 1584 - RNA, 59 nt, Vaccinia virus
uauuuuuguuuauaaaacaauuaauucguuucauaacguuauauacucuaacaaaaaua

SEQ ID NO: 1585 - RNA, 59 nt, Vaccinia virus
uccaguauuuugaugauauccaacucagaaaugguuguuguauuauuggguguauuggg

SEQ ID NO: 1586 - RNA, 61 nt, Vaccinia virus
aaguaaagauuucaaagauguuuucugucagaaaauaccauccaagucaauaucuuuacuu

SEQ ID NO: 1587 - RNA, 55 nt, Vaccinia virus
ugucaauugaguuuauaagaauuuuuauacauuaucuuccaacaagcaauugacg

SEQ ID NO: 1588 - RNA, 91 nt, Vaccinia virus
gauagauuuaucaaaacguggaugauuaauauuaugauacauaugaacguagauccuaauaauauaauaccgacguuagaaaaauacuauc

SEQ ID NO: 1589 - RNA, 55 nt, Vaccinia virus
gugcuaguuacgaaccagaaucagugaauaaauucaaguucggcgcagcuaguac

SEQ ID NO: 1590 - RNA, 55 nt, Vaccinia virus
aauucuuguagaguagaugaguaccuaaaaucuguuuccuuauaucauaagaauu

SEQ ID NO: 1591 - RNA, 81 nt, Vaccinia virus
auuguacugaauccgccuaagcgguguucuuuugcaugugcggauaauuuaacuacuauauuggcggaagacgguaacaau

SEQ ID NO: 1592 - RNA, 56 nt, Vaccinia virus
uauuuuuguaaaacuuuuuuuaugagaccaucaaagagagaaagagaauaaaaaua

SEQ ID NO: 1593 - RNA, 56 nt, Vaccinia virus; identical to SEQ ID NO: 1592

SEQ ID NO: 1594 - RNA, 55 nt, Vaccinia virus
ucaauaacuaaauggcggcggcgaaaacuccuguuauuguugugccaguuauuga

SEQ ID NO: 1595 - RNA, 56 nt, Vaccinia virus
gaaaggauuaauauauucuauggaauuuaccaaucuauugaguaagaauaccuuuu

SEQ ID NO: 1596 - RNA, 57 nt, Vaccinia virus
ccagaaggaacauacgacauauccgcauuuccaaagaaugauuucguaucuuucugg

SEQ ID NO: 1597 - RNA, 83 nt, Vaccinia virus
uaaugccggaggaauuggauuuacauuuucagagaaucacauuagaacuuagaaaacuaguauccauucagagaucggcguua

SEQ ID NO: 1598 - RNA, 55 nt, Vaccinia virus
gugaugccaauaagcuuuagauauucacgcgugcuaguguuagggaugguauuau

SEQ ID NO: 1599 - RNA, 56 nt, Vaccinia virus
acucauuucauuauaauaguuuaucauacuuagaauuuuaggacggaucaaugagu

SEQ ID NO: 1600 - RNA, 81 nt, Vaccinia virus
aauuguugccuguauuguauuagaguauuaauaugcgcaaugguguccuugcguuucucugauagaaugcgagcagcgauu

SEQ ID NO: 1601 - RNA, 55 nt, Vaccinia virus
uuaauuccacaaauuguauaaggauguuuaacuuuucuaaaagauauggaauuaa

SEQ ID NO: 1602 - RNA, 60 nt, Vaccinia virus
cguauuauacgcauuauaacugacagcgucguaaauagauguuucguuguauauaguacg

SEQ ID NO: 1603 - RNA, 107 nt, Vaccinia virus
ggaauaugacuauuuucacauguacuuuaugcugaggaccguguacugcaauaaaacauuuccuacuacuaaagcaaagguacuauuucuacaacaaucuauauuuc

SEQ ID NO: 1604 - RNA, 56 nt, Vaccinia virus
agauuucagcuucuggaauaggauaauaauuaauaucuauaauuuuauugagauuu

SEQ ID NO: 1605 - RNA, 55 nt, Vaccinia virus
auaguaacggcagggguauuaauaucaggguaucaaauaauaaaauguuaacuau

SEQ ID NO: 1606 - RNA, 84 nt, Vaccinia virus
uaucuaguuuuuugcguuucacaaacacaggcucgucucucgcgaugagaucuguauaguaacuauguaaaugauaacuagaua

SEQ ID NO: 1607 - RNA, 60 nt, Vaccinia virus
uagauacuuuacuucauauaaacguuuuguaacugauuauguucaugaaggaguaucuua

SEQ ID NO: 1608 - RNA, 94 nt, Vaccinia virus
ccagaaccauauucuuuaggaaagccuuuaucguugcuaaauuucuuauacucuacaaagauagacgacucuccaaagauaauugguucacugg

SEQ ID NO: 1609 - RNA, 102 nt, Vaccinia virus
caauuuggauauagcagccugaagcucaucuuguuuaguuacggauccuaaugaguuauuaagcaauauaucgaacggaugaacgaagguuguuuuaaguug

SEQ ID NO: 1610 - RNA, 58 nt, Vaccinia virus
uggaacagcucauagaaaauauuaacuuuaacaacucuaguauaauuucguuguucua

SEQ ID NO: 1611 - RNA, 81 nt, Vaccinia virus
gauauauguuccaacucugucuuugugaugucuaguuucguaauaucuauagcauccucaaaaaauauauucgcauauauu

SEQ ID NO: 1612 - RNA, 55 nt, Vaccinia virus
agguuugauuguaauuuuguuuauuauguuuaugcucaucuuuaacguuaaaucu

SEQ ID NO: 1613 - RNA, 107 nt, Vaccinia virus
cguuacggauuggcaaaucuuaucauuggucgguguuuggucuugcuuugugacuuugauaauaacaucgauucccauaugauguuuguuuucuucuuccguacacg

SEQ ID NO: 1614 - RNA, 56 nt, Vaccinia virus
auucugucuuuaagggauuuucugacaaaguuagaaaaaaugauuuagacaugaau

SEQ ID NO: 1615 - RNA, 55 nt, Vaccinia virus
cuuuuaucuuuaucauaaacuacucccaaggaugguguuuguguuggcauagaag

SEQ ID NO: 1616 - RNA, 65 nt, Vaccinia virus
auacagugauugcagauuugccauauauggauaaugcgguauccgauguaugcaauucacuguau

SEQ ID NO: 1617 - RNA, 58 nt, Vaccinia virus
aauggaguauauuuuugaugacacggauaugucucaucuuaaaguagcacucuaucgu

SEQ ID NO: 1618 - RNA, 101 nt, Vaccinia virus
uagcggauaucauuugaucggugaaucuaaaucguauugugaauuaggaucuacuggaucuaugguauggaaucccgaggcaccuauuugugaaucuguua

SEQ ID NO: 1619 - RNA, 57 nt, Vaccinia virus
uuggcauuauuaguauucuucuugucaucuuguucagaaauauacagcaaugcuaua

SEQ ID NO: 1620 - RNA, 56 nt, Vaccinia virus
uauauuugaaaaucguuacggcucgauuaaacuuuaaugauugcauagugaauaua

SEQ ID NO: 1621 - RNA, 55 nt, Vaccinia virus
auuuuuaaaagguauguagccuugacuacauucucauuaauuaaccauuccaagu

SEQ ID NO: 1622 - RNA, 56 nt, Vaccinia virus
gucaccguaaauuuaucaccagaaauacuaauaucuaucuuuauguccauggugau

SEQ ID NO: 1623 - RNA, 56 nt, Vaccinia virus
ugcguuagaacgcucgucgauauagauuuuagacauuuuuagagagaacuaacgca

SEQ ID NO: 1624 - RNA, 107 nt, Vaccinia virus
uaucucuaaacuucaaucuguuaagauuaauuucgaauuuguauguuugggagaauuaaauccagacaucacucuucgaaaagaaacagauagguauguaguagaua

SEQ ID NO: 1625 - RNA, 57 nt, Vaccinia virus
cuauuuuuaauaaugguguugauguggagucuagaaucaacacuacaggaaaguaug

SEQ ID NO: 1626 - RNA, 70 nt, Vaccinia virus
ucggccauacguuuacuuuuugcguauacauguccuggugauauaucauaaaggguaugcucauggccga

SEQ ID NO: 1627 - RNA, 57 nt, Vaccinia virus
caacauuaacaucuugaaccguugguacaauuccguuccauaaauuuauaauguucg

SEQ ID NO: 1628 - RNA, 71 nt, Vaccinia virus
ucacaaugacuuuaucagauuaaaauuaacaaaauuaaaggagcauguauuuuuuucugaauauauuguga

SEQ ID NO: 1629 - RNA, 60 nt, Vaccinia virus
ccauuaauaucucuauuauagcuucuggacauaauucaucuauuauaccagaauuaaugg

SEQ ID NO: 1630 - RNA, 58 nt, Vaccinia virus
agcaguuacaagauuuuuagcguauuauccuccgaugauguguuauuuuuuaacugcu

SEQ ID NO: 1631 - RNA, 55 nt, Vaccinia virus
uauuuuuacaaaaaaaauguauaaaguguaugucuuauguauauuuauaaaaaug

SEQ ID NO: 1632 - RNA, 55 nt, Vaccinia virus; identical to SEQ ID NO: 1631

SEQ ID NO: 1633 - RNA, 55 nt, Vaccinia virus
gauuuuaaccaguauguuuaauaugaaaaaaauaaacauaacauauuuugagauu

SEQ ID NO: 1634 - RNA, 102 nt, Vaccinia virus
cgucugcaccguuugauucaguauuuuaucuagacaauuugcugccuaguaaguuggauuauuuuacauaucuaggaacaacuaucaaccacucugcagacg

SEQ ID NO: 1635 - RNA, 58 nt, Vaccinia virus
uucugguuccuuaaaucuggugccguugugaaaucgguauauaauaaacuagauuaug

SEQ ID NO: 1636 - RNA, 55 nt, Vaccinia virus
aagaucugguacugguucgaacauuguaagacuuacaucaucgguaguagauuuu

SEQ ID NO: 1637 - RNA, 56 nt, Vaccinia virus
gaauguuugacugugccuaauauuacuauaucaaguaaugcugaauaaaaauauuu

SEQ ID NO: 1638 - RNA, 59 nt, Vaccinia virus
uggcgacgguucaguauuugcugccucaaaacagcaaauguugaugaaucacguugcua

SEQ ID NO: 1639 - RNA, 90 nt, Vaccinia virus
uagacgcgugucuagacgaaauagauuauuuaacggcuauucaagauuuuauuaucgaggugucaaacuguguagcuagauucgcguuua

SEQ ID NO: 1640 - RNA, 56 nt, Vaccinia virus
cuaguggguguagcaauuauucuaguuauuuuuacuguagcuauuuguucuauuag

SEQ ID NO: 1641 - RNA, 55 nt, Vaccinia virus
guacuuauucauaggugguaauaauaaaucguuacugaaaauauguaucaaguac

SEQ ID NO: 1642 - RNA, 105 nt, Vaccinia virus
gaagagguuggaauaucaacuagaugcugagaaagaaaaaguuaaguucuacaaaagagaacuagaacgugaucgguaucuuucuaguagauaucuuaccucuuc

SEQ ID NO: 1643 - RNA, 61 nt, Vaccinia virus
guuaucuauagcaucuacuaacuguacauuuuuuacaucuagaccauguaccuuagauaau

SEQ ID NO: 1644 - RNA, 73 nt, Vaccinia virus
ggcgaugguaaaaagacucuucgucuucccaaaauguuagagacggaaauaguugucaagauucucuaucgcc

SEQ ID NO: 1645 - RNA, 76 nt, Vaccinia virus
ucaguggguacucccggaggcggaucccguuuagggagcucaacacuuacuccgccacccauauuuaucucauuga

SEQ ID NO: 1646 - RNA, 74 nt, Vaccinia virus
gagacuggucuuagcgcaucagauguugauauggauuuugauuuaaacauuuuuaugacguugguuccagucuu

SEQ ID NO: 1647 - RNA, 57 nt, Vaccinia virus
uuuccucuucagucuucucacauugucuaauagacauggaguagaugauagagggga

SEQ ID NO: 1648 - RNA, 88 nt, Vaccinia virus
uaguggcuucuaaucagauguucuaauaaauauuuuaaaaaugaaucuugauuaaaaaucauaucauugaccauuugucuggcuacug

SEQ ID NO: 1649 - RNA, 55 nt, Vaccinia virus
uaauggaguucgcauuuguguaucuucaccucgugcguuuauaucauuuccguua

SEQ ID NO: 1650 - RNA, 56 nt, Vaccinia virus
uaacuaaauuguaguguauauauagaccauauauguuucuauuuuuuugacaguua

SEQ ID NO: 1651 - RNA, 55 nt, Vaccinia virus
ucuaaacguuucuguuagauugcuauggacgauucuaccaguuuguugaaauaga

SEQ ID NO: 1652 - RNA, 56 nt, Vaccinia virus
gcuuugaguuuuguugaaucgaugagugaaguaucaucgguugcaccuucagaugc

SEQ ID NO: 1653 - RNA, 56 nt, Vaccinia virus
aaaauauuuuuguaaaacuuuuuuuaugagaccaucagaaagagguuuaauauuuu

SEQ ID NO: 1654 - RNA, 55 nt, Vaccinia virus
ccaaaacauuuuuagacgauuccaacaaacgaaagguauuggcgauugauuuugg

SEQ ID NO: 1655 - RNA, 55 nt, Vaccinia virus
agugauaauauauuuuaaauuuuuaaaaaucauauuuugaauaauauguauuacu

SEQ ID NO: 1656 - RNA, 58 nt, Vaccinia virus
cauuagaaugggaauuuuuuauuguaacgaugaugaugcgguagauccccaucuaaug

SEQ ID NO: 1657 - RNA, 55 nt, Vaccinia virus
uaaagauauugacuuggaugguauuuucugacagaaaacaucuuugaaaucuuua

SEQ ID NO: 1658 - RNA, 69 nt, Vaccinia virus
uagucacagaaaccaugccguguagaauuauaccaaaaaauaaucacgcgguuauuucagucgugacua

SEQ ID NO: 1659 - RNA, 56 nt, Vaccinia virus
augaauaauauacauaucauacgguaaucuuuuuucuaaauaugauuuauauucgu

SEQ ID NO: 1660 - RNA, 56 nt, Vaccinia virus
ucaacauaaucaaugagccagguaaucaagacaucggauuuauuggguaguguuga

SEQ ID NO: 1661 - RNA, 55 nt, Vaccinia virus
auuucacaaauggauguuaauguauuaguaggaaauuuuuugacgcuaguggaau

SEQ ID NO: 1662 - RNA, 58 nt, Vaccinia virus
aucgucuaaacgaauauuagguaaagauauuuuucugagccaaaacuucacagacgau

SEQ ID NO: 1663 - RNA, 55 nt, Vaccinia virus
agucaauaaggaauuaauuuuaccauuugucauugucuuaacccauucguugauu

SEQ ID NO: 1664 - RNA, 56 nt, Vaccinia virus
uucguguacucauauauuuugcauaacaugcaucaauauauggcauaaaacacgaa

SEQ ID NO: 1665 - RNA, 56 nt, Vaccinia virus; identical to SEQ ID NO: 1664

SEQ ID NO: 1666 - RNA, 56 nt, Vaccinia virus
agauuguacaaguauuccaaguguauacggccguguuauaaauuaggagauaaucu

SEQ ID NO: 1667 - RNA, 56 nt, Vaccinia virus
aauggauacuaguuuucuaaguucuaaugugauucucugaaaauguaaauccaauu

SEQ ID NO: 1668 - RNA, 56 nt, Vaccinia virus
augauauagauuaucucuuaaaaaccuuugaaauaagacgaugauggaaauauuau

SEQ ID NO: 1669 - RNA, 70 nt, Vaccinia virus
aagaaagagauaggucuaacgccuauucaaaauuagaaaguaauggauuaguuagacugaaugcuuucuu

SEQ ID NO: 1670 - RNA, 81 nt, Vaccinia virus
guacccaauauguaaagaugaaaaaguaaauuacuauuaacgccguugauauucguuaguucauccauucaguauggguau

SEQ ID NO: 1671 - RNA, 56 nt, Vaccinia virus
acgaccaauaaauauauucagucaaacauugucugacgucaucaauacuggucagu

SEQ ID NO: 1672 - RNA, 56 nt, Vaccinia virus
uaauaauaucauuuacaauuaauaguauaaacuaaaaauuaaacaaaucguuauua

SEQ ID NO: 1673 - RNA, 63 nt, Vaccinia virus
agauuguauucugaaggauugaguauuaguaaugauuuaaacucgauaaucggucaacaaucu

SEQ ID NO: 1674 - RNA, 55 nt, Vaccinia virus
auaaaugauucaaccaugagugugaaacuaagucgagaauuacucaugcauuugu

SEQ ID NO: 1675 - RNA, 56 nt, Vaccinia virus
uauuuuuauucucuuucucucuuugauggucucauaaaaaaaguuuuacaaaaaua

SEQ ID NO: 1676 - RNA, 56 nt, Vaccinia virus; identical to SEQ ID NO: 1675

SEQ ID NO: 1677 - RNA, 81 nt, Vaccinia virus
ggauaugauuuauauagcgcuuacgauuauacuaucccuccaggagaacgacaguuaauuaagacagauauuaguaugucc

SEQ ID NO: 1678 - RNA, 56 nt, Vaccinia virus
auagguacauaaugcggacuaucgaagaauacauauaguaucguaucauuaucugu

SEQ ID NO: 1679 - RNA, 55 nt, Vaccinia virus
uauucuucauaaucuacuuuaucagugucauuuguaguugaugucauaaagaaug

SEQ ID NO: 1680 - RNA, 55 nt, Vaccinia virus
aaaaagucauguuggaacagugaauguaugcaaccguaucaaaaaauuacuuuuu

SEQ ID NO: 1681 - RNA, 56 nt, Vaccinia virus
aauuagucauuuuuccaucacaucuaaaaauagaaauugagagaaaaaaacuaauu

SEQ ID NO: 1682 - RNA, 56 nt, Vaccinia virus
ugaucuacacacagacgauggauuauuggauaggcuauacgaucugacuagauacg

SEQ ID NO: 1683 - RNA, 55 nt, Vaccinia virus
gagaguacacuaauccacaaaaaauagaauguuuaguuauuuuggauuuauuuuc

SEQ ID NO: 1684 - RNA, 56 nt, Vaccinia virus
ucaucuccagaggaaauauccucacaacuuaaugaagaucuauuuccagaugauga

SEQ ID NO: 1685 - RNA, 76 nt, Vaccinia virus
gauaacacagcaauagaucggaugauuuacuaaagucaucaaugguguccguuaguauaucaaagaucuuguuauc

SEQ ID NO: 1686 - RNA, 55 nt, Vaccinia virus
uaaaugccgauauuuguuaauacuguguacuguaagaauauauuagcauugucua

SEQ ID NO: 1687 - RNA, 55 nt, Vaccinia virus
cuaauaucgguaguuguaucaucuaccaacgguauaugaauaauauuaauauuag

SEQ ID NO: 1688 - RNA, 57 nt, Vaccinia virus
gucagcucgugugguuccaauguaacuggaagguauccauugguaacaaagcucgac

SEQ ID NO: 1689 - RNA, 102 nt, Vaccinia virus
uuacauucgcacucaagaaacuaaucauugauagagaagugguggcuaacguuaucggacucucuggagauagugaacguguaucaaugacugaaaauguag

SEQ ID NO: 1690 - RNA, 55 nt, Vaccinia virus
uauuauacgaucuacguuuuauuauaugauuuuaacguguaaauuauaaacauua

SEQ ID NO: 1691 - RNA, 55 nt, Vaccinia virus; identical to SEQ ID NO: 1690

SEQ ID NO: 1692 - RNA, 55 nt, Vaccinia virus
agguguacuauaguugacaguaugauaauagggcauauaggucaucauuauauuu

SEQ ID NO: 1693 - RNA, 55 nt, Vaccinia virus
guauccgcuuuauuuguaauugaccacgccauuacgauacaaacuuaacggauau

SEQ ID NO: 1694 - RNA, 55 nt, Vaccinia virus
auaaaaacuuuuagaaauauacagacucuaucgugugucuauaucuucuuuuuau

SEQ ID NO: 1695 - RNA, 56 nt, Vaccinia virus
gaauuauggcaucuuaaaacugcauauaguguagugucuagaacaguggauaguuu

SEQ ID NO: 1696 - RNA, 75 nt, Vaccinia virus
uucaaaagaggagcguaugaaauugucgauauuaaagaauuuaaacccgaaaaugaauugcgugacuauuuugaa

SEQ ID NO: 1697 - RNA, 55 nt, Vaccinia virus
cauggcugauaaaccucaugaaacggcuauuaaagagguuguuauggcuuaugug

SEQ ID NO: 1698 - RNA, 66 nt, Vaccinia virus
gaagguaguaauguuaguagacaauuuuuaucugugaaaacaggaaauaguuuaucauauaccuuu

SEQ ID NO: 1699 - RNA, 56 nt, Vaccinia virus
agaagcguguuauuguuccauauuaugggaucagguaaaacaauaaucgcuuuguu

SEQ ID NO: 1700 - RNA, 55 nt, Vaccinia virus
auggacauuauagguuuuaauaguacuucagauacuggaauaagauauuguucgu

SEQ ID NO: 1701 - RNA, 55 nt, Vaccinia virus
aucauauucgucucuaguauaaaauucuauauucagauuaucaugcgauguguau

SEQ ID NO: 1702 - RNA, 75 nt, Vaccinia virus
ugagacauuagcuaauauuaguacuauauuguacuuuaccaaguaugauccgguauuaauguuuuuauuguuuua

SEQ ID NO: 1703 - RNA, 97 nt, Vaccinia virus
gaaauaguucaugagguaaugauaguaaaaaagaaagagucuagugauaaaaucgauuuuuucccacccaacuauaaguuauugaaggaucuauuuc

SEQ ID NO: 1704 - RNA, 56 nt, Vaccinia virus
acuaugauauuauguugauuuccauaauaaucuucugaguuaauauauuucauggu

SEQ ID NO: 1705 - RNA, 56 nt, Vaccinia virus
gagcaaauaucggaauaaguagacauagccgguuuccguuuugcacguaaccauuc

SEQ ID NO: 1706 - RNA, 61 nt, Vaccinia virus
gggauauuauuuagugauuuauuugaaucggacgaaaucuguaaagacuuuaauauauccu

SEQ ID NO: 1707 - RNA, 55 nt, Vaccinia virus
auugauauauuuacaaaaggcaucguuugucagaugucuacugacuacuauuaau

SEQ ID NO: 1708 - RNA, 55 nt, Vaccinia virus
ucaauauugaaaauacuaauuguuuaaauaacccgaguauugaaacuauauaugg

SEQ ID NO: 1709 - RNA, 56 nt, Vaccinia virus
uugacaauucucuuugagccgauaguaucagugaaaagaauguaaacuuugucaua

SEQ ID NO: 1710 - RNA, 75 nt, Vaccinia virus
gauaaaagaugcauauauuagagaagauuguccuacugacuggauaagcuauaauaauaaauguauccauuuauc

SEQ ID NO: 1711 - RNA, 55 nt, Vaccinia virus
auuguuauuuuacacaucuugguuauauuauuagauauccuguuaagagaauaau

SEQ ID NO: 1712 - RNA, 57 nt, Vaccinia virus
uaucuaagguacauggucuagauguaaaaaauguacaguuaguagaugcuauagaua

SEQ ID NO: 1713 - RNA, 136 nt, Vaccinia virus
gaggauaaugcuauuaagguuaaggaucuguacgauaugauucauaacgucauugaugaugugagagagaaauacuucuuuacgguaucuaauauagauuuuauggaguauauauucuugacgcaucuuaauccuu

SEQ ID NO: 1714 - RNA, 118 nt, Vaccinia virus
ucauuaaaauagauucuauuccaggauuaaaaacuuauaacaugaaagacauuacauacgaaaagucuaauaauauaauuuguguuagguuuauaccucaagaaucaauucauaauga

SEQ ID NO: 1715 - RNA, 109 nt, Vaccinia virus
auaucuacuacauaccuaucuguuucuuuucgaagagugaugucuggauuuaauucucccaaacauacaaauucgaaauuaaucuuaacagauugaaguuuagagauau

SEQ ID NO: 1716 - RNA, 56 nt, Vaccinia virus
uuuuuuacgacuccaucagaaagagguuuaauauuuuugugagaccaucgaagaga

SEQ ID NO: 1717 - RNA, 56 nt, Vaccinia virus; identical to SEQ ID NO: 1716

SEQ ID NO: 1718 - RNA, 56 nt, Vaccinia virus; identical to SEQ ID NO: 1716

SEQ ID NO: 1719 - RNA, 98 nt, Vaccinia virus
uaaaauauaauauuaauguacuaaaacuuauauauuauuaauuuaucuaacuaaaguuaguaaauuauauauauaauuuuauaauuaauuuaauuuua

SEQ ID NO: 1720 - RNA, 55 nt, Vaccinia virus
cguaauaauaugccgaugaaauguaucaucgaugaaaauaaucgcauaguuacug

SEQ ID NO: 1721 - RNA, 55 nt, Vaccinia virus
aggcacaaugaaugauauagccgcucuaggagagccauucagcgcaaaguguccu

SEQ ID NO: 1722 - RNA, 199 nt, Vaccinia virus
aauaauaauagauuuaucuagucuaucuuuuucuauagcuuucauaguuagauacauggucucagaaguaggauuauguaacaucagcuucgauaaaaugacuggguuauuuagucuuacacauucgcucauacauguaugaccguuaacuacaaagucuacacuaaaaugauugaacaauagauagucuaccauuguu

SEQ ID NO: 1723 - RNA, 56 nt, Vaccinia virus
ucgucuaaacgaauauuagguaaagauauuuuucugagccaaaacuucacagacga

SEQ ID NO: 1724 - RNA, 56 nt, Vaccinia virus
aaauacacgaugguaaauuaauuuauauuuucuaaucaaucauccucaguuaauuu

SEQ ID NO: 1725 - RNA, 55 nt, Vaccinia virus
agugguaggucauacuccaucaauuucaaaaagagcuuauauggcaacgacuauu

SEQ ID NO: 1726 - RNA, 56 nt, Vaccinia virus
gacaaaauuaaaaguucuaccucuagauuuguaauguuuggauuuuguuauuuguc

SEQ ID NO: 1727 - RNA, 57 nt, Vaccinia virus
ugauugauaccuuuguacgacauuaaugcuauaguaacauguuggccgaagcaauua

SEQ ID NO: 1728 - RNA, 55 nt, Vaccinia virus
ugccaaauauaugguaaccgauaaaacggcguauauagguaccucaaauuggaca

SEQ ID NO: 1729 - RNA, 86 nt, Vaccinia virus
gaaccaauuaucuuuggagagucgucuaucuuuguagaguauaagaaauuuagcaacgauaaaggcuuuccuaaagaauaugguuc

SEQ ID NO: 1730 - RNA, 82 nt, Vaccinia virus
aauaugcaaagucuaaauauuuuuuagagaaucuuaauugguccaaauucuuuuccaaguacgguaauagauuuuucauauu

SEQ ID NO: 1731 - RNA, 55 nt, Vaccinia virus
guugaacauaaaacuaauauuuuauuucaaaauuauuuaccaucccauauauucc

SEQ ID NO: 1732 - RNA, 76 nt, Vaccinia virus
ccgcuucuauuuacucccgcagcacaaugaaccaacacgggcucguuucguugaucacauuuagauaaaaaggcgg

SEQ ID NO: 1733 - RNA, 56 nt, Vaccinia virus
aaggaacuaaucaacgaauggguuaagacaaugacaaaugguaaaauuaauuccuu

SEQ ID NO: 1734 - RNA, 65 nt, Vaccinia virus
ucucgucguacccaccgagagcgugugcguaaaacaucgccaugauuucgguuguacacacgaga

SEQ ID NO: 1735 - RNA, 56 nt, Vaccinia virus
acaauucauagcuguauuuugaauuccaaucacgcauaaaaauaucuuccaauugu

SEQ ID NO: 1736 - RNA, 78 nt, Vaccinia virus
uggcguccucuauaauauucccagaaaagauauuuucguguuuuaguuuaucgagaucugaucuguucauauacgcca

SEQ ID NO: 1737 - RNA, 56 nt, Vaccinia virus
uccauacguugaagauuuuuuagaagauagaacugaagacuugggaauauaugcga

SEQ ID NO: 1738 - RNA, 55 nt, Vaccinia virus
caggaucuagauaauuaauaaugauggguuuucuauucuuauucuuuguauuuug

SEQ ID NO: 1739 - RNA, 56 nt, Vaccinia virus
gaucaucucuuugcuaucuucuguauugugugcgcguaaaugaugcaaaaaugauu

SEQ ID NO: 1740 - RNA, 56 nt, Vaccinia virus
uuguaacuuuucauacacuguaaucaauacaguauuuaccauuugauuaauuacag

SEQ ID NO: 1741 - RNA, 57 nt, Vaccinia virus
guauuaguuaaauauuaaaacuuaccacguaaaacuuaaaauuuaaaaugauauuuc

SEQ ID NO: 1742 - RNA, 56 nt, Vaccinia virus
cgacgaguuuacuuuuacgcuccaucgauagauggcacuguucuaugagaucgucg

SEQ ID NO: 1743 - RNA, 55 nt, Vaccinia virus
cagauuguaguucuauaaucguaaauaauuuaccuauauuauauguuugagucug

SEQ ID NO: 1744 - RNA, 55 nt, Vaccinia virus
uacuuggaucuuuuguacaucgauaucgccgcaaucacuacaauaauuacaagua

SEQ ID NO: 1745 - RNA, 83 nt, Vaccinia virus
guuauagcuuucugcuauuauacccgcuauuucaaauagacuuauacgucuaguauagcgucguuuaagagcagauauaugau

SEQ ID NO: 1746 - RNA, 69 nt, Vaccinia virus
gguggaggucugagaaugaacuuuggauucaccaaauguccucagauuaaauccaucucagaauccgcu

SEQ ID NO: 1747 - RNA, 56 nt, Vaccinia virus
ucguuaggaauuuuaguauucucacaugaucauauuggacauggaagaaguaaugg

SEQ ID NO: 1748 - RNA, 55 nt, Vaccinia virus
gcgacgguucaguauuugcugccucaaaacagcaaauguugaugaaucacguugc

SEQ ID NO: 1749 - RNA, 97 nt, Vaccinia virus
cuguaaugcguaugcggagguuaauaauauuauagauauacagaaauuagauaucggagaauguucggcuccgcccggucaacauaugcuuuuacag

SEQ ID NO: 1750 - RNA, 79 nt, Vaccinia virus
guacgaugaguucaaauguuucauuaacuacguggaaacuaaguauuucuaaaauuaaugaugcauuaauuuuuuguau

SEQ ID NO: 1751 - RNA, 62 nt, Vaccinia virus
uagcacuaugauuuacuuuaccagcuucaacuuguaccauagguucaucauccccgucgcua

SEQ ID NO: 1752 - RNA, 56 nt, Vaccinia virus
ugaauguuuccauaccccauuccuuuacaaugacgcuaaaggagaugaaucguuca

SEQ ID NO: 1753 - RNA, 62 nt, Vaccinia virus
cgggauuguccggcauaucauguagauaguuaccgucuacaucguauacucgaccaucuacg

SEQ ID NO: 1754 - RNA, 63 nt, Vaccinia virus
guuaucuacaagaacaaauccguauucguuaaacacucugacuauaucguucuuuuugauaau

SEQ ID NO: 1755 - RNA, 61 nt, Vaccinia virus
uuugauuagacaaaugcguaugcacauaacagcauucuuuaccauucacaauaucaaaaug

SEQ ID NO: 1756 - RNA, 64 nt, Vaccinia virus
acuuuuuaugaagagccgcguuuaacaaugcuuuauugucuccgaacguagcucucuuaagagu

SEQ ID NO: 1757 - RNA, 62 nt, Vaccinia virus
uuuauaucccguacaucuauuuggacaguuuuuauguuaccuauaauguaugguccuauaaa

SEQ ID NO: 1758 - RNA, 55 nt, Vaccinia virus
uaaaugucaaguuuuuccauauuguuaaccacgaucgugcuauuagaguuauuua

SEQ ID NO: 1759 - RNA, 56 nt, Vaccinia virus
cccauuucucuaguaaguaucuuauguauauguuuguaaaauaucuucaugguggg

SEQ ID NO: 1760 - RNA, 55 nt, Vaccinia virus
guaauauuuagacauagauaaacgugauaaaagucuauuuguuuauauuuauugc

SEQ ID NO: 1761 - RNA, 55 nt, Vaccinia virus
gaacuuuuuaaguaaucccaacgaaaugggauaauagucacuugcaucuaaguuu

SEQ ID NO: 1762 - RNA, 55 nt, Vaccinia virus
gaaucguucgauuaacccuacucauccaauuucagaugaauagaguuaucgauuc

SEQ ID NO: 1763 - RNA, 85 nt, Vaccinia virus
uauugaccguuauaaaugucuuugucgaugauauauucaacgcuuccaauugugauauauccagagauaucuuguaauggcgaua

SEQ ID NO: 1764 - RNA, 56 nt, Vaccinia virus
ucaucaucuggaaauagaucuucauuaaguugugaggauauuuccucuggagauga

SEQ ID NO: 1765 - RNA, 58 nt, Vaccinia virus
cauucaugucuaaaucauuuuuucuaacuuugucagaaaaucccuuaaagacagaaug

SEQ ID NO: 1766 - RNA, 55 nt, Vaccinia virus
uauacacaucucuucaucgguaaguuuagacagaauaucgugaacaggugguaua

SEQ ID NO: 1767 - RNA, 55 nt, Vaccinia virus
uacagagcuuuauuaacuucucgcuucuccauauuaaguugucuaguuaguugug

SEQ ID NO: 1768 - RNA, 98 nt, Vaccinia virus
cccugauuauaguccuucuguuccccucuaucaucuacuccaugucuauuagacaaugugagaagacugaagaggaaacauggggauugaaaauaggg

SEQ ID NO: 1769 - RNA, 87 nt, Vaccinia virus
gaaaaaacaugugguauuagugcaggucguuauucuuccaauugcaauugguaagaugacggccaacuuuaguacccacgucuuuuc

SEQ ID NO: 1770 - RNA, 55 nt, Vaccinia virus
uggagaacauguuccauuuauaagaaauccaaauaaaauggauaacgguacucua

SEQ ID NO: 1771 - RNA, 56 nt, Vaccinia virus
cuucuaguugguaauugggauaagaacgacguauauucuauggcaaccgccagaag

SEQ ID NO: 1772 - RNA, 55 nt, Vaccinia virus
ggaaaaagcuuacaauaaacuccguagagaaauaucuauaauuugugaguuuucc

SEQ ID NO: 1773 - RNA, 55 nt, Vaccinia virus
ggauaaaaauuuuuuagauguaguaucuaaaacuacguucgaugaauuccuaucu

SEQ ID NO: 1774 - RNA, 55 nt, Vaccinia virus
uccauaaaagacgaauaagauacaaacacaaauguuuauauaauauuuaaaugga

SEQ ID NO: 1775 - RNA, 65 nt, Vaccinia virus
agaauaaaauaaaugaguaugaucauuuuagauaacgauugauuuuaucauuaccgcuucauucu

SEQ ID NO: 1776 - RNA, 55 nt, Vaccinia virus
ugauaaaauuaaccggauccauauuaguuuauauccaauagagguugcacuguua

SEQ ID NO: 1777 - RNA, 56 nt, Vaccinia virus
cauauaacaauaguuagauacaaggauaccgaagaauuaaaucuaacgagaauaug

SEQ ID NO: 1778 - RNA, 58 nt, Vaccinia virus
auuagaagauccuaauuauguucccacaauuacaagaacggcuauaggaaucgcugau

SEQ ID NO: 1779 - RNA, 56 nt, Vaccinia virus
aggcaaauacgauagucuagauugaccgaugguagacucuaauuuauugagugcuu

SEQ ID NO: 1780 - RNA, 78 nt, Vaccinia virus
gauggaaugcaaaaccccauagugaaacaaccaacgauaaaaauaauauuguuuuucacuuuuuauaauuuuaccauc

SEQ ID NO: 1781 - RNA, 56 nt, Vaccinia virus
uagagacggcugucuuccaaaaauaauacuuguauauucuugaacagcuacuucua

SEQ ID NO: 1782 - RNA, 55 nt, Vaccinia virus
auauuacguuucuucgucccgucuugaaggcaaugcaugacaaaaaaauagauau

SEQ ID NO: 1783 - RNA, 64 nt, Vaccinia virus
gaacaacaaagcgauuauuguuuuaccugaucccauaauauggaacaauaacacgcuucuguuc

SEQ ID NO: 1784 - RNA, 56 nt, Vaccinia virus
ggaauaucuguuguagcguuuguaauuucuggcgaugucguuucgauagcguuacc

SEQ ID NO: 1785 - RNA, 56 nt, Vaccinia virus; identical to SEQ ID NO: 1784

SEQ ID NO: 1786 - RNA, 58 nt, Vaccinia virus
gaagaauagcuauauagaaaauacuaaucagggaaacauucugauggauagcaucuuc

SEQ ID NO: 1787 - RNA, 134 nt, Vaccinia virus
cgacgauaacgaaguauuuauacuuuuaggaaaucacaaugacuuuaucagauuaaaauuaacaaaauuaaaggagcauguauuuuuuucugaauauauugugacuccagauacauauggaucuuuaugcgucg

SEQ ID NO: 1788 - RNA, 55 nt, Vaccinia virus
uauuaauaacgugcucauuaggcaguuuauggcagcuugauaauuagauauagua

SEQ ID NO: 1789 - RNA, 71 nt, Vaccinia virus
guucgaucgccuucagaaagacugcucugauaaacucgauagagagaaggagagacgcaugaaggcugaac

SEQ ID NO: 1790 - RNA, 72 nt, Vaccinia virus
uuuaccguuugcauguuaccacuaucaaccgcauaauacaaugcgguguuucccuugucaucaaauugugaa

SEQ ID NO: 1791 - RNA, 64 nt, Vaccinia virus
uauagcgugaaggauaugauaaaaaauauaauuguuguauuuaucccauuccaaucaccuuaua

SEQ ID NO: 1792 - RNA, 56 nt, Vaccinia virus
aucuacauccucgacugauguggaaucaucuucugauuccaccucgggaucuggau

SEQ ID NO: 1793 - RNA, 56 nt, Vaccinia virus
guguccaagguaaaaucguguuuguguaguuuucacaaugaugccaucauagauau

SEQ ID NO: 1794 - RNA, 55 nt, Vaccinia virus
cguauccagucaacacuauguuagcauuucugucgauauagcuuucacucauaug

SEQ ID NO: 1795 - RNA, 62 nt, Vaccinia virus
aaugucgggccaauaguagcuauuaccgucgacacguguagugggaacuauggccaaauguu

SEQ ID NO: 1796 - RNA, 81 nt, Vaccinia virus
uaacacuuauguauuaacuuuguucauuuauauuuuuucauuauuauguugauauuaacaaaagugaauauauauauguua

SEQ ID NO: 1797 - RNA, 199 nt, Vaccinia virus
uaguucugaccagcaacucauuucuucaucauccaccuguuuuaacauauaauaggcaggagauagauauccgucauugcaauauuccuucucguaggcacacaaucuaauauugauaaaaucuccauucucuucucugcauuuauuaucuuguuucgguggcugauuaggcuguagucuugguuuaggcuuugguaua

SEQ ID NO: 1798 - RNA, 75 nt, Vaccinia virus
gguuucucuucguguuuuaugccauauauugaugcauguuaugcaaaauauaugaguacacgaauccaauaaacc

SEQ ID NO: 1799 - RNA, 75 nt, Vaccinia virus; identical to SEQ ID NO: 1798

SEQ ID NO: 1800 - RNA, 56 nt, Vaccinia virus
ugaaacuuuguccuuuccuacaaacuugauaacuauuucaucgggacuuauuucua

SEQ ID NO: 1801 - RNA, 63 nt, Vaccinia virus
cucguguguacaaccgaaaucauggcgauguuuuacgcacacgcucucgguggguacgacgag

SEQ ID NO: 1802 - RNA, 60 nt, Vaccinia virus
ugccggagaguaaacauugacggauaaaacaaaaaugcuccgcauaacucuaucauggca

SEQ ID NO: 1803 - RNA, 61 nt, Vaccinia virus
gaagagauguaacgggaacaggguuuguugauucgcaaacuauucuaauacauaauucuuc

SEQ ID NO: 1804 - RNA, 56 nt, Vaccinia virus
guacuguaaaaauagaaacuauaaucauauaauaguguagguugguaguaggguac

SEQ ID NO: 1805 - RNA, 56 nt, Vaccinia virus
guuccguguguaauaaccuacgcguauuaucacguuggggauauagucagaggaac

SEQ ID NO: 1806 - RNA, 55 nt, Vaccinia virus
auaucgauuuaagugguaaacgauuauuguuuacgcucauuaaugaagagauguu

SEQ ID NO: 1807 - RNA, 111 nt, Vaccinia virus
gaacagaauauuggacgauagucgguaauacagauagacaauucuauaaugcaaauguuuuacauaauugucuauacauuauuggcggcaugauuaacaauagacauguuu

SEQ ID NO: 1808 - RNA, 56 nt, Vaccinia virus
uuguagaagauccacaaccaauaaccucgaaaguuaagguuauaaacuauauacaa

SEQ ID NO: 1809 - RNA, 63 nt, Vaccinia virus
uaauggcggaaaacuuuuuagaaauguuauauauaaaagaauuuuuucguguuccaaacauua

SEQ ID NO: 1810 - RNA, 67 nt, Vaccinia virus
guggaggucugagaaugaacuuuggauucaccaaauguccucagauuaaauccaucucagaauccgc

SEQ ID NO: 1811 - RNA, 55 nt, Vaccinia virus
gauaugugauaucuucuauaaauauaugagcauauauuuacggagaugaaauauc

SEQ ID NO: 1812 - RNA, 56 nt, Vaccinia virus
uuauuucgugaaauaaagucaucguaggauuuuggacuuauauucgcgucuaguag

SEQ ID NO: 1813 - RNA, 87 nt, Vaccinia virus
auucguggugugccugaaucguucgauuaacccuacucauccaauuucagaugaauagaguuaucgauucagacacacgcuuugagu

SEQ ID NO: 1814 - RNA, 70 nt, Vaccinia virus
auauguguauuaucagauauccaaaauuuuguaugaagaacuccuccuaggauauuuguaauaucuaugu

SEQ ID NO: 1815 - RNA, 56 nt, Vaccinia virus
gguacuucuuaccaacaucuuaagcguagaaguuguaaaugacaaugagauguacc

SEQ ID NO: 1816 - RNA, 56 nt, Vaccinia virus
aaauauaacagguaguauacucauuuuauuuuauaguggguaaaaaaaguuuguuu

SEQ ID NO: 1817 - RNA, 55 nt, Vaccinia virus
uacuuuucuauagccgcagaaucugaaaauuucaaacuuuuguacagacuaagua

SEQ ID NO: 1818 - RNA, 56 nt, Vaccinia virus
agauauuaaugucguauuugaacagagccuguaacaucucaaugucuuuauuaucu

SEQ ID NO: 1819 - RNA, 101 nt, Vaccinia virus
uaguauacauagaguuaagagagauuagaguuuguacauuaagcaacaugucucuaaauguggcuacaaacuuuuccuuuuucacauaaucuaguuuauua

SEQ ID NO: 1820 - RNA, 56 nt, Vaccinia virus
auaaauuuguggaacuguuaagugaauacauucacauugaccaaucagaauuuuau

SEQ ID NO: 1821 - RNA, 55 nt, Vaccinia virus
gaguuuaaaacuuuguauaaucuuuuuauagauaguuauuuacaaaaauuagcuc

SEQ ID NO: 1822 - RNA, 56 nt, Vaccinia virus
gcugguacguguaccguauccauaggugauauguuggauaacauuacaacccaguc

SEQ ID NO: 1823 - RNA, 55 nt, Vaccinia virus
ucgucuauagauguggacaaacggacuaagcucauguccaacauaaaaacgauga

SEQ ID NO: 1824 - RNA, 56 nt, Vaccinia virus
aucuauauuauuaaaguacguaaaucuagcuauaguuuuauuauuuaauuuuagau

SEQ ID NO: 1825 - RNA, 66 nt, Vaccinia virus
ugaucuauuucguccauaaacaaucuagacauaggaauuggaggcgaugaucuuaauuuugugcaa

SEQ ID NO: 1826 - RNA, 56 nt, Vaccinia virus
aauauucaagaugauaauauugucuucucaccguuugguuauucguuuucuauguu

SEQ ID NO: 1827 - RNA, 90 nt, Vaccinia virus
auuguucggcuauacucgaugcgugagucuugcauucaucuccagauaucggagugagggucagauccaaauauugagaagccuuauaau

SEQ ID NO: 1828 - RNA, 55 nt, Vaccinia virus
ugugaucaucuucauaggauuaacaacuauguauggugccgccugaaguuucaua

SEQ ID NO: 1829 - RNA, 56 nt, Vaccinia virus
uauucucauccauuuuaggauaggcuuucauaaagucccuaauaacuucgugaaua

SEQ ID NO: 1830 - RNA, 55 nt, Vaccinia virus
gauguuguaaaguguacgaagcgguuuuacgacacgcauuugaugcacccacguu

SEQ ID NO: 1831 - RNA, 61 nt, Vaccinia virus
auuguuuguauucauucaaugucucuuuuucagaaauuaguuuagagucgaauacugcaau

SEQ ID NO: 1832 - RNA, 56 nt, Vaccinia virus
gaccauucgauuuaauaaaaaaaucagaugcuaaacgcaauucuaaaucguugguc

SEQ ID NO: 1833 - RNA, 56 nt, Vaccinia virus
acuauuuucguaacuggcggauuauucauaaauaacucuaauagcacgaucguggu

SEQ ID NO: 1834 - RNA, 55 nt, Vaccinia virus
ccgaaauugauguguuaccguuugauauuaaauacauaucuagagaugaauugug

SEQ ID NO: 1835 - RNA, 56 nt, Vaccinia virus
auauauuuaugguauuuccuaucuggaaaguaaguuaucaagucaucauaagauau

SEQ ID NO: 1836 - RNA, 95 nt, Vaccinia virus
gaucauauaguuauguauauuagugacgaaucaagugauucagaaaauaauccugaauauauugauuuucguaacagauacgaagacuauagauc

SEQ ID NO: 1837 - RNA, 57 nt, Vaccinia virus
gaugacgaugaaaaugaugguacauauauauuucguaucauuauuguuauugcuauu

SEQ ID NO: 1838 - RNA, 55 nt, Vaccinia virus
gucuaucaucgggauuuuauuuugaaauagccagaauugaaaacgaaaugaagau

SEQ ID NO: 1839 - RNA, 55 nt, Vaccinia virus
uucaaaaacaguaaaguugugagauuaaccccgcaaguuaaauguuuaaaugaua

SEQ ID NO: 1840 - RNA, 55 nt, Vaccinia virus
gugaauugcauacaucggauaccgcauuauccauauauggcaaaucugcaaucac

SEQ ID NO: 1841 - RNA, 55 nt, Vaccinia virus
cgaaauaaauaaugaauuggaacuaguauuuauuaagccgccauugauuacuuug

SEQ ID NO: 1842 - RNA, 56 nt, Vaccinia virus
aauuagaacuagaaacauguuuagaaagaaacgauuauuucugaauuauuccaauu

SEQ ID NO: 1843 - RNA, 55 nt, Vaccinia virus
ucuuacaaaauaauuauauagauaucuuggcaucuauaauagauuacgugcaaga

SEQ ID NO: 1844 - RNA, 56 nt, Vaccinia virus
uuucaugcaacgaauuauuagucugucuguagauaaacuaggauuuaaacaagaaa

SEQ ID NO: 1845 - RNA, 56 nt, Vaccinia virus
gaauacuuguacaaucuaagauagacuaaaucucgcaaaguuguaucauggaauuc

SEQ ID NO: 1846 - RNA, 55 nt, Vaccinia virus
ggccauuuguagucuuucaacauccuuuaaugguuuguuagauuuauugacggcu

SEQ ID NO: 1847 - RNA, 57 nt, Vaccinia virus
augcaauagcugauaauaacgugcgucuaguauguacguuguugaacgcuggagcau

SEQ ID NO: 1848 - RNA, 55 nt, Vaccinia virus
ugauaaugccuuuauagcggggagacgaucauguacuaacuuccaugcaccauca

SEQ ID NO: 1849 - RNA, 101 nt, Vaccinia virus
guucaaagaacuagauguaaauacguugggugcacgauuaacguuaacucuuuagcguuaaaaaauucccaagcggaacuuacgucuaauuguacuagaac

SEQ ID NO: 1850 - RNA, 140 nt, Vaccinia virus
uacuaaaaagguuaaggaucuguuuaauacuaaaucugauucuauuuaucaauacguuagacuucaugaaaugucauaugaugguguuucagaagauacggaugaugacgaugagguauucgcuauccuuaacuugagua

SEQ ID NO: 1851 - RNA, 55 nt, Vaccinia virus
acgaaaaaauagcaaccaguguuugaucauccgcgucaauauucuguucuaucgu

SEQ ID NO: 1852 - RNA, 56 nt, Vaccinia virus
uuuaaauuagaugaaucgauaaaaucuauauuguugguaaacccgucgucuauaga

SEQ ID NO: 1853 - RNA, 55 nt, Vaccinia virus
auuaaaucaugaaguccguauuauacucguauauauuguuucucucauguauaau

SEQ ID NO: 1854 - RNA, 55 nt, Vaccinia virus; identical to SEQ ID NO: 1853

SEQ ID NO: 1855 - RNA, 60 nt, Vaccinia virus
ugcuaauuacaacauaggagacacuauagaauaucuaugucuaccuggauacagaaagca

SEQ ID NO: 1856 - RNA, 56 nt, Vaccinia virus
acuuacuuauuagguaugaucguuaagaauuguaacuugaaugcugaugaacaggu

SEQ ID NO: 1857 - RNA, 55 nt, Vaccinia virus
ucggacacuauuguugugauacagcggcaguugauagguuagaacaucacaucga

SEQ ID NO: 1858 - RNA, 58 nt, Vaccinia virus
ccagacgugacguguauagaacguguagagaucacgcuacccguguacgcgcaacugg

SEQ ID NO: 1859 - RNA, 64 nt, Vaccinia virus
uaauacuagcgugaacaacuuacagauggauaaaacuuccucauuaagauugucauguggauua

SEQ ID NO: 1860 - RNA, 56 nt, Vaccinia virus
uaccagguacgacgucacugcaaaaucuaguuuuguaugugguauaguacgaggua

SEQ ID NO: 1861 - RNA, 76 nt, Vaccinia virus
guucagacuuuuaacgcgccugaauguaucgacaaagggcaauauuuugcaucauucauggaguuagaaaacgagc

SEQ ID NO: 1862 - RNA, 56 nt, Vaccinia virus
gauuagaugguugggagguaucuugccauggacuaagauaucugaaacaaagaauu

SEQ ID NO: 1863 - RNA, 81 nt, Vaccinia virus
gauuauuauguguuauaagguacuuuuucucauaauaaacuagaguaugaguaagauaguguuuuucaaaacauauaaauc

SEQ ID NO: 1864 - RNA, 55 nt, Vaccinia virus
ucgcauuuaucuaaccauucaauuaguuuauuaauaacuaguugguaaucagcga

SEQ ID NO: 1865 - RNA, 57 nt, Vaccinia virus
ugcuauucgcaucaaugggcuuuaaggugacuacuagaagauccauuaugggaagca

SEQ ID NO: 1866 - RNA, 55 nt, Vaccinia virus
auccauagauggaguaaguagucuauuaaaggaacuaaagacucaaaguccggau

SEQ ID NO: 1867 - RNA, 60 nt, Vaccinia virus
aucaauacaucaucuauagaucauguaacaauauuacaauacauagaugaaccaaaugau

SEQ ID NO: 1868 - RNA, 60 nt, Vaccinia virus; identical to SEQ ID NO: 1867

SEQ ID NO: 1869 - RNA, 60 nt, Vaccinia virus
ugccaugauagaguuaugcggagcauuuuuguuuuauccgucaauguuuacucuccggca

SEQ ID NO: 1870 - RNA, 81 nt, Vaccinia virus
uuuaauugagucauucgaagcgucaauagaauaugucucuuaacuauuuccggcuguuguauauuuaaaugacuucguaaa

SEQ ID NO: 1871 - RNA, 65 nt, Vaccinia virus
uagccgcugagugguaaacaacagaacagauaguuuauuaucuuuaccaacacccucagccgcug

SEQ ID NO: 1872 - RNA, 56 nt, Vaccinia virus
cggaccuagugguauaucuuguucuauguaucuaaaauaaugucugacuagauccg

SEQ ID NO: 1873 - RNA, 89 nt, Vaccinia virus
uauacgauaagauauguuuauucauaaacgcgucaaauuuuucaugaaucgcuaaggaguuuaagaaucucaugucaaauuguccuaua

SEQ ID NO: 1874 - RNA, 55 nt, Vaccinia virus
uuaucagauuuuuugcuuccaguuuuaucaguagauauacaacagaguuucauaa

SEQ ID NO: 1875 - RNA, 56 nt, Vaccinia virus
cugccgaauacagugcuaggggaaaaauuauaauauuuccucuuucguauucguag

SEQ ID NO: 1876 - RNA, 108 nt, Vaccinia virus
uuaccagacaauuguauaucauaaaauaauguuuauaauuuacacguuaaaaucauauaauaaaacguagaucguauaauauuuuuugguauauaaaugaucuaguaa

SEQ ID NO: 1877 - RNA, 108 nt, Vaccinia virus; identical to SEQ ID NO: 1876

SEQ ID NO: 1878 - RNA, 59 nt, Vaccinia virus
gcuccaggauauacauuguauaaaaagcuaucguuuuuuaguaguguuuuuuucugagu

SEQ ID NO: 1879 - RNA, 55 nt, Vaccinia virus
cauccguucgauauauugcuuaauaacucauuaggauccguaacuaaacaagaug

SEQ ID NO: 1880 - RNA, 55 nt, Vaccinia virus
ggaucggaccauucuccuccugaacacaggacaccagaguuaccaaucaacgaau

SEQ ID NO: 1881 - RNA, 56 nt, Vaccinia virus
ucaucagcugaaaaacuauguuuuacacguauuccuucggcauuucuuuuuaauga

SEQ ID NO: 1882 - RNA, 55 nt, Vaccinia virus
uagccaaugaggguucgaguucaacgacgauugaauucucuucccgcggaugcug

SEQ ID NO: 1883 - RNA, 55 nt, Vaccinia virus
cuuccagaugugguuauuucagcaccuaaagcagucuuuaagcccgcuaaagaag

SEQ ID NO: 1884 - RNA, 55 nt, Vaccinia virus
uuagccagagauaucauagccgcucuuagaguuucagcgugauuuuccaaccuaa

SEQ ID NO: 1885 - RNA, 55 nt, Vaccinia virus
guauccacgcuagagauauugacgguauguauuguagaugcucucaugguuauac

SEQ ID NO: 1886 - RNA, 55 nt, Vaccinia virus; identical to SEQ ID NO: 1885

SEQ ID NO: 1887 - RNA, 55 nt, Vaccinia virus
uuauccagggaaauuaaagaagaaguuaauauagacaauucuuuuguauucauag

SEQ ID NO: 1888 - RNA, 56 nt, Vaccinia virus
ucuacccauaaguuaucucuaacaaaacuauuuaguuauggcacucuuauuauaga

SEQ ID NO: 1889 - RNA, 55 nt, Vaccinia virus
auaacgauuuguuuaauuuuuaguuuauacuauuaauuguaaaugauauuauuau

SEQ ID NO: 1890 - RNA, 64 nt, Vaccinia virus
ucgucgguauuuuuuauggcaaacuuuacucuuccagcauccguuucuaaaaaaauauuaacga

SEQ ID NO: 1891 - RNA, 83 nt, Vaccinia virus
cucccugaucuauguaucuagcgguguuauuauaaacucucaacauuggaauaauaccguuugauauaccauugguaccggag

SEQ ID NO: 1892 - RNA, 106 nt, Vaccinia virus
uauuguaacaauuuauuuuguauugcacauguucgugaucuaugaguucuucuucgaauggcauaggaucuccgaaucugaaaacguauaaauaggaguuagaaua

SEQ ID NO: 1893 - RNA, 55 nt, Vaccinia virus
cgcgguuagauauuacgaugguaacauauaugaauuagcuaaagauauaaaugcg

SEQ ID NO: 1894 - RNA, 56 nt, Vaccinia virus
cuccguauuuugugaaggugaauuacguauauguaccgauaccgcugauaaggacg

SEQ ID NO: 1895 - RNA, 56 nt, Vaccinia virus
accagaccuaggagcuauucuaccauagcagaacuuaggcauggacauacuaauau

SEQ ID NO: 1896 - RNA, 56 nt, Vaccinia virus
uucugcauuauuguaauucguaugcuggcaccaucaaagaaucacuucuaaaagaa

SEQ ID NO: 1897 - RNA, 56 nt, Vaccinia virus
gauagccugauugucuggaccaucguuugucauaacuccggauagagaaauauauu

SEQ ID NO: 1898 - RNA, 74 nt, Vaccinia virus
gucugcuggcgaccgucauauuaucucuagcuaguuguucucgcaacugucuuugauaauacgacucuugagac

SEQ ID NO: 1899 - RNA, 55 nt, Vaccinia virus
aaagggugaguuaauaugcauaacuacuccuccguuguuuuuucccucguucuuu

SEQ ID NO: 1900 - RNA, 56 nt, Vaccinia virus
augagggacuugagaggcgcauuuguggaaaauccaucguuuaaaagacagaucau

SEQ ID NO: 1901 - RNA, 56 nt, Vaccinia virus
uggaguagaaacaaaaacagacgcgggugcgucaacauaugugcuuccucaaucca

SEQ ID NO: 1902 - RNA, 108 nt, Vaccinia virus
gaguuuucuuaggauuagacaguaugcauucucuuuuauuguuccaugaaacgggugucgguaaaacaaugacuacuguauauauucucaaacaucuuaaggauauuu

SEQ ID NO: 1903 - RNA, 55 nt, Vaccinia virus
gaguuacacacauugauccauugggaacuaaugugauggguagugcuguucauuc

SEQ ID NO: 1904 - RNA, 56 nt, Vaccinia virus
guuaucugauucccuggcacguuuaagaucuucaugcaauugagucagcucuuaac

SEQ ID NO: 1905 - RNA, 76 nt, Vaccinia virus
ggcuucucaauauuuggaucugacccucacuccgauaucuggagaugaaugcaagacucacgcaucgaguauagcc

SEQ ID NO: 1906 - RNA, 55 nt, Vaccinia virus
auauuauacaaacaguuuaaaaauguacgaaauauagaggugagcagugauauau

SEQ ID NO: 1907 - RNA, 88 nt, Vaccinia virus
cauguacgauggauuaaaugauuaucuacauucuguuauuaucgacgaggacuuaauagaggaauauaaaauuaaauccguugccaug

SEQ ID NO: 1908 - RNA, 56 nt, Vaccinia virus
augguagugauuaauaccuugccuccagaagcaguuaguucggauaaguuauucau

SEQ ID NO: 1909 - RNA, 56 nt, Vaccinia virus
aacauaagacagauuaugcugguuaugcuugcugcguaauaugcggucuaauuguu

SEQ ID NO: 1910 - RNA, 56 nt, Vaccinia virus
ucaguaauuggaauaagcgucuucucgauggaguguccguauaccaacaugucuga

SEQ ID NO: 1911 - RNA, 55 nt, Vaccinia virus
guuauaaucuagauauuaaagauagaaaaugcuccgucgcagauaugugguugau

SEQ ID NO: 1912 - RNA, 85 nt, Vaccinia virus
uauuuaguauuagguauagcauugcuguauauuucugaacaagaugacaagaagaauacuaauaaugccaacacuaauaaugaua

SEQ ID NO: 1913 - RNA, 55 nt, Vaccinia virus
cuaguauauucucuaaagaugauaucugucacagauauucguagagcguuucuag

SEQ ID NO: 1914 - RNA, 80 nt, Vaccinia virus
gagcuauaguuaauugaccguguaauauuugcuuacaugcauacuugauacgcucauuaauaaaauuuuuaucauugcuc

SEQ ID NO: 1915 - RNA, 56 nt, Vaccinia virus
uauuuauuuuugugauauugauauaauauguaauguuauuaauauuucggauaaug

SEQ ID NO: 1916 - RNA, 56 nt, Vaccinia virus; identical to SEQ ID NO: 1915

SEQ ID NO: 1917 - RNA, 55 nt, Vaccinia virus
gaguucuguaaugaacggauuugacuugcuacaaauacugguuuuauuauaauuu

SEQ ID NO: 1918 - RNA, 56 nt, Vaccinia virus
uaccucguacuauaccacauacaaaacuagauuuugcagugacgucguaccuggua

SEQ ID NO: 1919 - RNA, 58 nt, Vaccinia virus
gaucucacaucagaaauuaaaauaaucuuagaaggaugcaguuguuuuuugauggauc

SEQ ID NO: 1920 - RNA, 55 nt, Vaccinia virus
ucgaugaugucgcuauacgguacuaugguauugauaaaauuaaugagauugucga

SEQ ID NO: 1921 - RNA, 55 nt, Vaccinia virus
uuggugaauccaucucuauguuucaguuuaaccaagaaacagucagcuggucuaa

SEQ ID NO: 1922 - RNA, 92 nt, Vaccinia virus
uacuugcgugucgucguucaauuuauacggauuucuauaguucucuguuauauaaugcgguuuuccaucaugauuagacgacgacaauagug

SEQ ID NO: 1923 - RNA, 55 nt, Vaccinia virus
ugaguuggcuacuaucuuguacguauauugcauggaaucauagauggccuuuuca

SEQ ID NO: 1924 - RNA, 59 nt, Vaccinia virus
cucauuaucuacuaucaauuggccggauacauuuuaacgguuuuggguuugggauugag

SEQ ID NO: 1925 - RNA, 55 nt, Vaccinia virus
aaaguuaucugcucccucuucagaauuuaaucuaaguuucugcuugaguucuucu

SEQ ID NO: 1926 - RNA, 91 nt, Vaccinia virus
uccauuuuauauggacgauagagauauuaauccgauugugaaaacaucguugccuauagauuacagauuucguuuucguagcguguaugga

SEQ ID NO: 1927 - RNA, 56 nt, Vaccinia virus
uuacuuuccagauaggaaauaccauaaauauauuucuaaaguauuugaacauguag

SEQ ID NO: 1928 - RNA, 55 nt, Vaccinia virus
ucuauuucaacaaacugguagaaucguccauagcaaucuaacagaaacguuuaga

SEQ ID NO: 1929 - RNA, 75 nt, Vaccinia virus
uacaauacgauaaacauuguuauuuagauacuaacauuaaaaugucuacagauaaugcgguuuaucagugucgua

SEQ ID NO: 1930 - RNA, 55 nt, Vaccinia virus
ucgauuauaaguacacauguagcauguauccaucauauauagaauuuauaaccga

SEQ ID NO: 1931 - RNA, 55 nt, Vaccinia virus
acgauaaguccuuuaaaauauauucuaauauuaugaaugagagauaccuuaaugu

SEQ ID NO: 1932 - RNA, 55 nt, Vaccinia virus
ccuaagaugauaaaaaacuuaacucaacuguuuaaauauguuccaucugcagagg

SEQ ID NO: 1933 - RNA, 55 nt, Vaccinia virus
gacagaagaauaugaugauuagauggagaguauauuuuaucuaacucuuugaguu

SEQ ID NO: 1934 - RNA, 60 nt, Vaccinia virus
ucaaggaaauggaagaaacagaagacuuuuaauucuuaucaauaacauauuuuucuauga

SEQ ID NO: 1935 - RNA, 98 nt, Vaccinia virus
gucauucauuuagaaugguuguugggcuuuaucaaguguauuagucagcaucagcauuuggcuauuauguuuaaagaugacaauauuauuaugaagac

SEQ ID NO: 1936 - RNA, 55 nt, Vaccinia virus
cuuagguuuuuggaaaaaacaucauuuuauaauuguaacgauucaauaacuaaag

SEQ ID NO: 1937 - RNA, 55 nt, Vaccinia virus
uucauuuuuauuuaugaguguuaaaaauaguauacacugucgagcacuaaaagga

SEQ ID NO: 1938 - RNA, 55 nt, Vaccinia virus
uguagaaaucgauacaguuuuuagaacaaagauuuuuaaguauguaauuuucaca

SEQ ID NO: 1939 - RNA, 55 nt, Vaccinia virus
auaaguaauuacgagccguugcugcuguuaguuauaacaugcuguguacuacuau

SEQ ID NO: 1940 - RNA, 56 nt, Vaccinia virus
gcgauagccauguaucuacuaaucagaucuauuagagauauuauuaauucuggugc

SEQ ID NO: 1941 - RNA, 55 nt, Vaccinia virus
aggacacuuugcgcugaauggcucuccuagagcggcuauaucauucauugugccu

SEQ ID NO: 1942 - RNA, 62 nt, Vaccinia virus
gcuaucgcauuuuuugguuucuuucauuucaguuauguauggauuuagcacguuugggaagc

SEQ ID NO: 1943 - RNA, 56 nt, Vaccinia virus
guaaucuaugccuuuagcuagagcuauuuuaagcuuuucuguaucucgacugaugc

SEQ ID NO: 1944 - RNA, 55 nt, Vaccinia virus
ucuaaaauguauaacaaauacagaaaucaauucguucgaugaguauauauuaaga

SEQ ID NO: 1945 - RNA, 72 nt, Vaccinia virus
uggaaugauacuguuacguguccuaaugcggaaugucaaccucuucaauuagaacacggaucgugucaacca

SEQ ID NO: 1946 - RNA, 55 nt, Vaccinia virus
gaaaaauauuuuacauuuuuaguuauugccauuaaugccauguuuaauagcguuc

SEQ ID NO: 1947 - RNA, 98 nt, Vaccinia virus
gugacauguguuaacuuagagacugauccaacaaagauuaauccccauuaccuacaccccaaggauaaauaucuuuaucauaauucugaguauagcau

SEQ ID NO: 1948 - RNA, 56 nt, Vaccinia virus
cgcacaaaaucauaaaaaaucagcacacuuuuuacuuauuuuugaugauguaggug

SEQ ID NO: 1949 - RNA, 56 nt, Vaccinia virus
uaaacacuauuacccauacaucagucuaaauaugauuaguaaaaaguauaaaguua

SEQ ID NO: 1950 - RNA, 55 nt, Vaccinia virus
aguaccggaauaaaauaagguggauacgaauauaaaucuauuuaguuccuugauu

SEQ ID NO: 1951 - RNA, 55 nt, Vaccinia virus
aguaccgauagguuauugacauuguaugguuuuaaauauucuauaacuugagacu

SEQ ID NO: 1952 - RNA, 84 nt, Vaccinia virus
cuaacuuaaaagaauuacuuagucuguacaaaaguuugaaauuuucagauucugcggcuauagaaaaguauaauucuuugguag

SEQ ID NO: 1953 - RNA, 56 nt, Vaccinia virus
uguaguacuuugaugauuuuuccauggcccauucuauuaagucuuccaaguuggca

SEQ ID NO: 1954 - RNA, 55 nt, Vaccinia virus
gguauauauagauagucauaacgucgucaauuuauuacgugcuucuauauuaacc

SEQ ID NO: 1955 - RNA, 56 nt, Vaccinia virus
aguauaaaacauuaaauguccguacuuauuaaaguauucaguagccaauccuaacu

SEQ ID NO: 1956 - RNA, 56 nt, Vaccinia virus
aguauauauagaaucgccaaguuuuuauuuaugaacaggccagauguuaucaaacu

SEQ ID NO: 1957 - RNA, 56 nt, Vaccinia virus
cugaucgcauaugugucuauccaaauagucggugacucgucuaauaaugaauacag

SEQ ID NO: 1958 - RNA, 55 nt, Vaccinia virus
acuaugcucuaagcggaaucggguacgagagucuagacuuguguuuggaaggagu

SEQ ID NO: 1959 - RNA, 90 nt, Vaccinia virus
gaaauuagcaauguuaaagugacuccuccagauuacucaccuauaaucgcgaguauuaaagguaagaguuaugaugcauuagccacguuc

SEQ ID NO: 1960 - RNA, 55 nt, Vaccinia virus
uugauuuuacucauuggaugcauucuauaacgaaugaaucuaugaucaucuccaa

SEQ ID NO: 1961 - RNA, 62 nt, Vaccinia virus
cgucuacgguaugguugucuucguauauauuaucuaugcacuccuuuccuauacuguauacg

SEQ ID NO: 1962 - RNA, 56 nt, Vaccinia virus
aaacuuauauauuauuaauuuaucuaacuaaaguuaguaaauuauauauauaauuu

SEQ ID NO: 1963 - RNA, 70 nt, Vaccinia virus
uugcaaguuucuguuucugagaguaaacgaaucccuguuuuauuuuauuccacagagcacuaauuuccaa

SEQ ID NO: 1964 - RNA, 55 nt, Vaccinia virus
augcuacagauauuaucauuagucauguuaaaaaugacgacgauaucgguaccgu

SEQ ID NO: 1965 - RNA, 55 nt, Vaccinia virus
augcggaauuuuauugugaauccagcaauacauggacucugauagaugauccuau

SEQ ID NO: 1966 - RNA, 56 nt, Vaccinia virus
uaccguugugucuacaaccgcuacauaaucguagauucauguuaacacucuacgua

SEQ ID NO: 1967 - RNA, 105 nt, Vaccinia virus
guacaugugaaaauagucauauuccugauuaggauaaucaaaguuaacaacuacuuuguuacggacgaucuuauuaagguaguacaucuuuuuuucauaauuuac

SEQ ID NO: 1968 - RNA, 55 nt, Vaccinia virus
auccauuucugaaucaguguuuuuuuucauuuuagaagcaauucuuuuagacgau

SEQ ID NO: 1969 - RNA, 56 nt, Vaccinia virus
agacuuuacaagaucuacaggaaugcguacuucagguuucuuagcuugugauuuuu

SEQ ID NO: 1970 - RNA, 56 nt, Vaccinia virus
uggcugcccccggaagaaccaucauaaacuuacuaagauucaauuccucugguuca

SEQ ID NO: 1971 - RNA, 60 nt, Vaccinia virus
ucccuauuuugaaauugcuaacuccauaaacaucguguucagccauuuucuuaauuagga

SEQ ID NO: 1972 - RNA, 55 nt, Vaccinia virus
agucuuaccuuacuaucuuccagacucuaaggauccagaaggaagagguuacauu

SEQ ID NO: 1973 - RNA, 56 nt, Vaccinia virus
uaacuuuauacuuuuuacuaaucauauuuagacugauguauggguaauaguguuua

SEQ ID NO: 1974 - RNA, 57 nt, Vaccinia virus
acggucgcgucuuccguuacaacuuagacaagcggguaaaugauuauugcgagaugu

SEQ ID NO: 1975 - RNA, 55 nt, Vaccinia virus
auaguuauagaggcuauacacacgguuacuggaccaguggggcaacuguggaugu

SEQ ID NO: 1976 - RNA, 67 nt, Vaccinia virus
uaagauauccauagauggaguaaguagucuauuaaaggaacuaaagacucaaaguccggauguauua

SEQ ID NO: 1977 - RNA, 57 nt, Vaccinia virus
gaagaagacaucucaauugauucuagcuauaauucuuuaaucuuuugauacuuguuc

SEQ ID NO: 1978 - RNA, 55 nt, Vaccinia virus
gauggucgaguauacgauguagacgguaacuaucuacaugauaugccggacaauc

SEQ ID NO: 1979 - RNA, 56 nt, Vaccinia virus
uuugugagaccaucgaaggagaaagagauaaaacuuuuuuacgacuccaucagaaa

SEQ ID NO: 1980 - RNA, 56 nt, Vaccinia virus
uuggauguguuaucgauacuaaaacuuuguaagccguauauugaugauauaaacaa

SEQ ID NO: 1981 - RNA, 56 nt, Vaccinia virus
ugggauuuuacuuaauauaauauuauuucccgugauaaauuuuauuagaaaggcca

SEQ ID NO: 1982 - RNA, 55 nt, Vaccinia virus
auggaaauacaccucuccauauuguaugcucuaaaacagucaagaauguagacau

SEQ ID NO: 1983 - RNA, 55 nt, Vaccinia virus
auggccauuaccuacuguccauccacaugcgauagaugguaguauuccaccacau

SEQ ID NO: 1984 - RNA, 55 nt, Vaccinia virus
gcgggugcuggagugcuugauaaagauuuauuuacagaggaacagcagcaaucgu

SEQ ID NO: 1985 - RNA, 56 nt, Vaccinia virus
cugggguaaaguaaguauuuauaaaacucauauaguuaagccugaauuuauuucag

SEQ ID NO: 1986 - RNA, 55 nt, Vaccinia virus
uucguuuuaugagguauuuagagauuagagaugauuaaugauccccauacuagaa

SEQ ID NO: 1987 - RNA, 67 nt, Vaccinia virus
aacuaacggaucuagucagacauuauuuuagauacauagaacaagauauaccacuagguccguuguu

SEQ ID NO: 1988 - RNA, 131 nt, Vaccinia virus
agauauuucgugccauagcgucuccggauuccaagaaagcauucagucuaacuaauccauuacuuucuaauuuugaauaggcguuagaccuaucucuuucuuuguuauuaaaguuuuccaacggaauuucu

SEQ ID NO: 1989 - RNA, 55 nt, Vaccinia virus
aguuugauuuuuaguuauuaucuacaggaacaaauauaguaucugaaaucauauu

SEQ ID NO: 1990 - RNA, 57 nt, Vaccinia virus
agauccgaguuauuccaaacuaacgaguaugcauuuuuacggauggagucucggucu

SEQ ID NO: 1991 - RNA, 103 nt, Vaccinia virus
guuuucuaaagaugucauuaaacccucgaucaugaauggauuuaucaucaucguuuuuauguuggacaugagcuuaguccguuuguccacaucuauagacgac

SEQ ID NO: 1992 - RNA, 56 nt, Vaccinia virus
aauucaguaaccguagguauuugugcaccguaacuacaaagaauggugacuguguu

SEQ ID NO: 1993 - RNA, 55 nt, Vaccinia virus
cuauugccacaaauuuggaauauaaaacacuaugugauaugauuaaggguacuag

SEQ ID NO: 1994 - RNA, 75 nt, Vaccinia virus
aucuaagacauguauuaauacccuugauuugugcugcuaugucuccacaauuuucacaaacauacacaucuugau

SEQ ID NO: 1995 - RNA, 55 nt, Vaccinia virus
gaguagacauuguugauggauuauauaccacuauucuaucaucagcuauuuuuuc

SEQ ID NO: 1996 - RNA, 78 nt, Vaccinia virus
uucugagucuuuuaaaacuucuguaauaguauuggcugcgccaugcgcuauuaaacagucucucuccauuucuccgaa

SEQ ID NO: 1997 - RNA, 67 nt, Vaccinia virus
gguuguauuccauauuuguuauuuuuucuguaauaguuagaaaaauacauucgauggucuaucuacc

SEQ ID NO: 1998 - RNA, 67 nt, Vaccinia virus
gagucgauaccuagaagaucgugauugaucucuccgaccauuccacgaacuucuaauuggccgucuc

SEQ ID NO: 1999 - RNA, 55 nt, Vaccinia virus
auuugaaaauguguauaccgccccauuaacacccguguauaauacgucgucuaau

SEQ ID NO: 2000 - RNA, 56 nt, Vaccinia virus
ucuucaguacaucguuuguaaaguaauuauuauacaaauagcaguguagugcagua

SEQ ID NO: 2001 - RNA, 55 nt, Vaccinia virus
ucauucucucgcaucuggacggggacgaaggucuucucucacacgcgggcgauga

SEQ ID NO: 2002 - RNA, 55 nt, Vaccinia virus
gguuaauauagaagcacguaauaaauugacgacguuaugacuaucuauauauacc

SEQ ID NO: 2003 - RNA, 60 nt, Vaccinia virus
ccauacgauacauauguaggaucguacgccaguaacgguauucuacaauaugaucuuugg

SEQ ID NO: 2004 - RNA, 56 nt, Vaccinia virus
gcuuaguaauuuaacuauuuuaguuaacaacuauuuuuuauguuaaaucaauuagu

SEQ ID NO: 2005 - RNA, 56 nt, Vaccinia virus
cgguauugguguucaaggauuagcggacgcguuuauucucuuaaauuauccauuug

SEQ ID NO: 2006 - RNA, 58 nt, Vaccinia virus
cuauauaaugauuuuaaaaauucauuaagagauagagaauuuucuaaaucugcauuag

SEQ ID NO: 2007 - RNA, 56 nt, Vaccinia virus
auaucccguacaucuauuuggacaguuuuuauguuaccuauaauguaugguccuau

SEQ ID NO: 2008 - RNA, 55 nt, Vaccinia virus
gagucauaacuauuuuaccguuuguacuuacuggaauagacgaaggaauaaucuc

SEQ ID NO: 2009 - RNA, 55 nt, Vaccinia virus
ugcuccagcguucaacaacguacauacuagacgcacguuauuaucagcuauugca

SEQ ID NO: 2010 - RNA, 55 nt, Vaccinia virus
cggucucuacugaaucuacuaacaugucucguauguuagcuucuacagucuuucg

SEQ ID NO: 2011 - RNA, 55 nt, Vaccinia virus
guaugcauucucuuuuauuguuccaugaaacgggugucgguaaaacaaugacuac

SEQ ID NO: 2012 - RNA, 56 nt, Vaccinia virus
auguggucaaaguaauugucagaaaucucaauaaaauuauagauauuaauuauuau

SEQ ID NO: 2013 - RNA, 56 nt, Vaccinia virus
gauugguaacaucguuuacaaacgacauacuguauguaaacaaucugucacugauu

SEQ ID NO: 2014 - RNA, 56 nt, Vaccinia virus
uccugaagguuuuuagacuuguauuccucguaauccauaccgucccaaaacaugga

SEQ ID NO: 2015 - RNA, 145 nt, Vaccinia virus
ucauugaggacgaggauaauauuagauuuacugucuaucuaaauuucguugaaccagaggaauugaaucuuaguaaguuuaugaugguucuuccgggggcagccaacaagggaaagauuaguaaauucaagauuccuaucucuga

SEQ ID NO: 2016 - RNA, 199 nt, Vaccinia virus
ucuuuggaauugggaaccucuaaaagauaaaaucagaacauacggucuuagaaauaguuuauugguggcaccuaugccgacugcaucaacugcucaaauuuugggaaauaaugagucgguggaaccguauaccaguaauauuuacacucggagaguauugucuggagaauuucaaguaguuaauccgcaucuccuuaga

SEQ ID NO: 2017 - RNA, 55 nt, Vaccinia virus
uauuuguauaauaauuacuuuacaaacgauguacugaagauauuauuaaaucaug

SEQ ID NO: 2018 - RNA, 61 nt, Vaccinia virus
agauuaaaucuccacauugaauaguuacauuugauucaucuucgauguuuaauguuccucu

SEQ ID NO: 2019 - RNA, 55 nt, Vaccinia virus
ggauuauauggaacacgauuauuauaaaauaacaauaguuccugguuccucuucc

SEQ ID NO: 2020 - RNA, 79 nt, Vaccinia virus
uguuuuuuauguuuuguaucgauuauaaaaauuaguagauaugaucuauauuccuacaucgugacagauacauucuaua

SEQ ID NO: 2021 - RNA, 55 nt, Vaccinia virus
agaguuagaaauagauaaugaacauauaguucgucauuuaauaauuuuugaugcu

SEQ ID NO: 2022 - RNA, 55 nt, Vaccinia virus
guaguaaagaugcuaguguaccaauaugugaaucauuuuugcaucauuuacgcgc

SEQ ID NO: 2023 - RNA, 56 nt, Vaccinia virus
cgauuauaagauguuaaccuucgacguguuucgaccauuauuugauuuuguaaacg

SEQ ID NO: 2024 - RNA, 55 nt, Vaccinia virus
ugaguaacuuaacucuuuuguuaauuaaaaguauauucaaaaaaugaguuauaua

SEQ ID NO: 2025 - RNA, 55 nt, Vaccinia virus
uuaguaaugauuauaauagggacaugaauaucauguaugauauggcaucuacaaa

SEQ ID NO: 2026 - RNA, 55 nt, Vaccinia virus
uaaauuguuaaugaaaggaauagauaacacugcuuauucauauauagacgaucua

SEQ ID NO: 2027 - RNA, 55 nt, Vaccinia virus
gaaguggauauacauagucgugaucaacauuauugcuagccucaucuucuauauc

SEQ ID NO: 2028 - RNA, 82 nt, Vaccinia virus
aaaggagauacaaaucuauaauaaaggcucgagucgucuggaaagcgauuauagaaucucagauugaaacugguacuccauu

SEQ ID NO: 2029 - RNA, 55 nt, Vaccinia virus
agacaucgacggaagaguauucgauaaggcagauggaaaaucuaaacgagaugcu

SEQ ID NO: 2030 - RNA, 55 nt, Vaccinia virus
ccacaaauugcacguuuggaagcgccacgguuacauucacugcagcauuuugagg

SEQ ID NO: 2031 - RNA, 56 nt, Vaccinia virus
gcaggacauugaugcucuagaccguguauaacaaaaucuacaaauuuuucauccgc

SEQ ID NO: 2032 - RNA, 56 nt, Vaccinia virus
ugaacacuaauuccgcaucaucucuaaaagagaggaguguggaauacaauugucca

SEQ ID NO: 2033 - RNA, 56 nt, Vaccinia virus
gaaaaauuggagacugauguucuaugggaaaacuggauggaaaacuucauuuuauc

SEQ ID NO: 2034 - RNA, 55 nt, Vaccinia virus
gaaugcuagauuguccagcguguccccaggacaagguaaggacucucccgcgauc

SEQ ID NO: 2035 - RNA, 55 nt, Vaccinia virus; identical to SEQ ID NO: 2034

SEQ ID NO: 2036 - RNA, 55 nt, Vaccinia virus
ucaacaaaaucuagacgauauggcccuuaaggaucucaugucgaauguugaaaga

SEQ ID NO: 2037 - RNA, 55 nt, Vaccinia virus
uaaaagauauacauuaacugguucagaaauaucggcguaagagaauuuucuaaua

SEQ ID NO: 2038 - RNA, 104 nt, Vaccinia virus
gcaaaacaauauugaccguuauaaaugucuuugucgaugauauauucaacgcuuccaauugugauauauccagagauaucuuguaauggcgauaucuugucggu

SEQ ID NO: 2039 - RNA, 55 nt, Vaccinia virus
ucaaagcaucaaaauaggagauaucuuuaacgaggauaaacuaucggauguggga

SEQ ID NO: 2040 - RNA, 55 nt, Vaccinia virus
guaaauuauauaucaaacaauuggauuccaauuccuccgaugaauagccccagac

SEQ ID NO: 2041 - RNA, 56 nt, Vaccinia virus
uuaaaaaauguagaauguguugacaucgauaguacaauaacuuuuaugaaauacga

SEQ ID NO: 2042 - RNA, 55 nt, Vaccinia virus
guaaaucuaaugcaaaauguaucgaauacguuacacuaaaugcuucucaauacgc

SEQ ID NO: 2043 - RNA, 55 nt, Vaccinia virus
guaacguaugccuuuaauggaguuucaccaucauacucauauaauggauuugcac

SEQ ID NO: 2044 - RNA, 55 nt, Vaccinia virus
cuaaggaaaauagacuguccaucuuguccaaggauaagauggauucauuuaagag

SEQ ID NO: 2045 - RNA, 56 nt, Vaccinia virus
aaaagugucauaccggguucuuuuuauucuuuuaaacagaucaauggugugauguu

SEQ ID NO: 2046 - RNA, 55 nt, Vaccinia virus
caacgucgauuugaugaacacacgaugaaaaugugcuucuaugagauugaucaug

SEQ ID NO: 2047 - RNA, 55 nt, Vaccinia virus
auacuuuugugaugucggaaaucuuaaccaauuuagacugacaggcagaacacgu

SEQ ID NO: 2048 - RNA, 56 nt, Vaccinia virus
guacagcacgugguaacuauuaaaucuacuuauugggucauuccaugggagcuagc

SEQ ID NO: 2049 - RNA, 56 nt, Vaccinia virus
guacaacucaucaauucauacgccggaauaugauguuauaauccacguaauugagc

SEQ ID NO: 2050 - RNA, 55 nt, Vaccinia virus
gaacagaucagaucucgauaaacuaaaacacgaaaauaucuuuucugggaauauu

SEQ ID NO: 2051 - RNA, 104 nt, Vaccinia virus
gaacaggcuguuaaagaagagauuaguacgaguuuauccuucaaugacaagaauaccacagaugaaaugacguauaacuuguaugaucuuuuuuuuaacacauu

SEQ ID NO: 2052 - RNA, 55 nt, Vaccinia virus
auacccucccuaguaauugcucuauuugcauauuguugauuacugccgagcaaau

SEQ ID NO: 2053 - RNA, 55 nt, Vaccinia virus
acacuagcauuguucaaugugcucuuuacauggguaaggaguugaaauagcucgu

SEQ ID NO: 2054 - RNA, 56 nt, Vaccinia virus
ggagaauguuacaccggcuuuagaucucuaauagaugauacuccgauugacguauc

SEQ ID NO: 2055 - RNA, 60 nt, Vaccinia virus
ccaguuauggggacgcgcucauuagaauauguauaaaucugaggaguguauuccuugagg

SEQ ID NO: 2056 - RNA, 56 nt, Vaccinia virus
auauucagaaaaaaauacaugcuccuuuaauuuuguuaauuuuaaucugauaaagu

SEQ ID NO: 2057 - RNA, 55 nt, Vaccinia virus
uuaugagugcuugguauaaggagcccaauuccauuauucuuuuagcugcuaaaag

SEQ ID NO: 2058 - RNA, 55 nt, Vaccinia virus
gaauuauguauuagaauaguuugcgaaucaacaaacccuguucccguuacaucuc

SEQ ID NO: 2059 - RNA, 55 nt, Vaccinia virus
auauucuaccauggcuccguuuaauuuguugaugaagauggauucauccuuaaau

SEQ ID NO: 2060 - RNA, 79 nt, Vaccinia virus
ggcuauucuggcggcuagaauggcauaauccggauguuguguaguacaaguggcugcuauuucggcugccagagugucc

SEQ ID NO: 2061 - RNA, 66 nt, Vaccinia virus
gccguuacuauuauuuauaacugauguaauccacguaacauuagaauuaauuaucgauaguaaugc

SEQ ID NO: 2062 - RNA, 56 nt, Vaccinia virus
uucuaucaaagauguuauacacgauuauauuuguuggcucaguaugacugaugaaa

SEQ ID NO: 2063 - RNA, 55 nt, Vaccinia virus
uucauaauguuaagcauauccugaauaguaaaguuagaugugucauacuuguuag

SEQ ID NO: 2064 - RNA, 55 nt, Vaccinia virus
cucuguuuuauuaaccgaacgaggagaccauauaguuuggauuaauaauucaugg

SEQ ID NO: 2065 - RNA, 56 nt, Vaccinia virus
cgcacuaucgauuugauacuuucuuuucagaguaaagcuaucgucauugaucaucg

SEQ ID NO: 2066 - RNA, 56 nt, Vaccinia virus
aucaugaguaccuaguucauauguuuuuggaaugcaugaaggagguuuucuaauau

SEQ ID NO: 2067 - RNA, 55 nt, Vaccinia virus
ucgagcuuuguuaccaauggauaccuuccaguuacauuggaaccacacgagcuga

SEQ ID NO: 2068 - RNA, 71 nt, Vaccinia virus
uagaccgcauauuacgcagcaagcauaaccagcauaaucugucuuauguuuguucauugucguguggugua

SEQ ID NO: 2069 - RNA, 56 nt, Vaccinia virus
auguagaagagggaagagaaggauguuacaauuauaagaaccuuaaugaucuggau

SEQ ID NO: 2070 - RNA, 56 nt, Vaccinia virus
uaguaucugaaaucauauucauauaucccguuagaggucuaugauaauauauagua

SEQ ID NO: 2071 - RNA, 55 nt, Vaccinia virus
uugugagaccaucgaagagagaaagagauaaaacuuuuuuacgacuccaucagaa

SEQ ID NO: 2072 - RNA, 55 nt, Vaccinia virus; identical to SEQ ID NO: 2071

SEQ ID NO: 2073 - RNA, 55 nt, Vaccinia virus; identical to SEQ ID NO: 2071

SEQ ID NO: 2074 - RNA, 55 nt, Vaccinia virus; identical to SEQ ID NO: 2071

SEQ ID NO: 2075 - RNA, 55 nt, Vaccinia virus; identical to SEQ ID NO: 2071

SEQ ID NO: 2076 - RNA, 55 nt, Vaccinia virus; identical to SEQ ID NO: 2071

SEQ ID NO: 2077 - RNA, 55 nt, Vaccinia virus; identical to SEQ ID NO: 2071

SEQ ID NO: 2078 - RNA, 55 nt, Vaccinia virus; identical to SEQ ID NO: 2071

SEQ ID NO: 2079 - RNA, 55 nt, Vaccinia virus; identical to SEQ ID NO: 2071

SEQ ID NO: 2080 - RNA, 55 nt, Vaccinia virus; identical to SEQ ID NO: 2071

SEQ ID NO: 2081 - RNA, 55 nt, Vaccinia virus; identical to SEQ ID NO: 2071

SEQ ID NO: 2082 - RNA, 55 nt, Vaccinia virus; identical to SEQ ID NO: 2071

SEQ ID NO: 2083 - RNA, 55 nt, Vaccinia virus; identical to SEQ ID NO: 2071

SEQ ID NO: 2084 - RNA, 55 nt, Vaccinia virus; identical to SEQ ID NO: 2071

SEQ ID NO: 2085 - RNA, 56 nt, Vaccinia virus
acguaguaaucgucguagggagagacaucuuguagaacaacgauuuaaucauaggu

SEQ ID NO: 2086 - RNA, 56 nt, Vaccinia virus
aagacgucacagguacccaaguuauugcuuugguuuaauuauuuauuugguggauu

SEQ ID NO: 2087 - RNA, 55 nt, Vaccinia virus
aagacuagacauuuaccaugggaugcuaauauucccaaacauacaucuauaaauu

SEQ ID NO: 2088 - RNA, 55 nt, Vaccinia virus
uugauaccacgucacgugaauuaaaacuguuuaauguuacacuuaacgcuggaaa

SEQ ID NO: 2089 - RNA, 55 nt, Vaccinia virus
gagauagauacgugauuaauacauuuauauccaacauaugguacguaaccgaauc

SEQ ID NO: 2090 - RNA, 88 nt, Vaccinia virus
acgauggugaaagaguacaaguucauaaaaauaauaacgaguuugccuucuuuaguagaaacaugaaaccaguacucucucauaaagu

SEQ ID NO: 2091 - RNA, 55 nt, Vaccinia virus
augaugaauaugaugaagauagcgauaaagaaaagccaauauucaauguauaaau

SEQ ID NO: 2092 - RNA, 69 nt, Vaccinia virus
gugcuuuauauugugagauuuuuuccauucuucgauaacggaugguuuaaguacucuaguauaaaaugc

SEQ ID NO: 2093 - RNA, 55 nt, Vaccinia virus
augcgaauuacuuauaccgauagauaucaacucgaugcuaugguaucuaggaaau

SEQ ID NO: 2094 - RNA, 70 nt, Vaccinia virus
gcgguauaauuaguuuuuuucucucaauuucuauuuuuagaugugauggaaaaaugacuaauuuuguagc

SEQ ID NO: 2095 - RNA, 55 nt, Vaccinia virus
uaggauacggaguauccggagacgucaucuguucuccguguggucucggaacaua

SEQ ID NO: 2096 - RNA, 55 nt, Vaccinia virus
ucguuuuaacgugucauagauacccucuaugcuaucaucgaucauguuaaguaga

SEQ ID NO: 2097 - RNA, 57 nt, Vaccinia virus
gaguauuuaugacuaacuuuucgaugguauaucguacgaaggucuacauaaaccauc

SEQ ID NO: 2098 - RNA, 117 nt, Vaccinia virus
uguagcgguuggauaggcugucugcuggcgaccgucauauuaucucuagcuaguuguucucgcaacugucuuugauaauacgacucuugagacuuuaguccuauuucaaucgcuuca

SEQ ID NO: 2099 - RNA, 56 nt, Vaccinia virus
gauaaacuuccguuuaaaaaugguguauuggaccugguagacggaauguuuuacuc

SEQ ID NO: 2100 - RNA, 66 nt, Vaccinia virus
uguaggauaucuauuuuuuugucaugcauugccuucaagacgggacgaagaaacguaauauccuca

SEQ ID NO: 2101 - RNA, 62 nt, Vaccinia virus
cauguaguaagugucgauuguaauaaggaacugaugccuauuaggacagauacuacuauuug

SEQ ID NO: 2102 - RNA, 55 nt, Vaccinia virus
uuugucucauauguucuucuaucucucggauauuaagauuugucaaguuggauaa

SEQ ID NO: 2103 - RNA, 55 nt, Vaccinia virus
cauaauauccuuauccgacuuuauauuuccuguagggugguauaauuuuauuuug

SEQ ID NO: 2104 - RNA, 55 nt, Vaccinia virus
uguccaauuugagguaccuauauacgccguuuuaucgguuaccauauauuuggca

SEQ ID NO: 2105 - RNA, 55 nt, Vaccinia virus
acucaucguuccauaguuuuuuuaccucaguggcgaaaucuuuggagugcuuggu

SEQ ID NO: 2106 - RNA, 56 nt, Vaccinia virus
auugauaaaaauacuaauaucuagagcauauauuaaugauauuuauuuuacuccgu

SEQ ID NO: 2107 - RNA, 56 nt, Vaccinia virus
acuaaaaauaaacauugauuaaauuuuaauauaauacuuaaaaauggauguugugu

SEQ ID NO: 2108 - RNA, 56 nt, Vaccinia virus
uauauaaugauuuuaaaaauucauuaagagauagagaauuuucuaaaucugcauua

SEQ ID NO: 2109 - RNA, 56 nt, Vaccinia virus
uuucaucagucauacugagccaacaaauauaaucguguauaacaucuuugauagaa

SEQ ID NO: 2110 - RNA, 55 nt, Vaccinia virus
caucuucuucaauaccaucauagaauauauuauagcuacuaucuauuauagauug

SEQ ID NO: 2111 - RNA, 56 nt, Vaccinia virus
guucuuagaguuuucgaauagaguauacgaagcucucuauuacguucacucguugc

SEQ ID NO: 2112 - RNA, 56 nt, Vaccinia virus
gcugcuuggguuaauaugccgagucuucugaaaccuagauguaauccagcaguggc

SEQ ID NO: 2113 - RNA, 55 nt, Vaccinia virus
uuuuuugucuauaauauccauuuuguucaucucgguacauagauuauccaauuga

SEQ ID NO: 2114 - RNA, 56 nt, Vaccinia virus
aauuuauuuaucaauuuuaaagguauaaaaaauacuuauuguugcucgaauauuuu

SEQ ID NO: 2115 - RNA, 55 nt, Vaccinia virus
cguuaccaagaaaaauaauaauaucaaaaacgauguugugauuuuguuauugucg

SEQ ID NO: 2116 - RNA, 55 nt, Vaccinia virus
aauuccuuauccuguuccugaaauaaaguaucuaaauuauucaucagauuaaguu

SEQ ID NO: 2117 - RNA, 55 nt, Vaccinia virus
uguuccgguguuaauccacuauauguuucuguagcggcugauaacacagcaucca

SEQ ID NO: 2118 - RNA, 72 nt, Vaccinia virus
gguuuacuaucguuaaaaauuugaacgaugacgaguuuucuuguuaucuguuuucacaaaauuauaguuucc

SEQ ID NO: 2119 - RNA, 56 nt, Vaccinia virus
guuuuuauucucuuaauuauaacgauaacgucauuaauuauaacggauuaucucgc

SEQ ID NO: 2120 - RNA, 63 nt, Vaccinia virus
gauuuugugauuuuucuuccuaaacuguuuacguaaauaguuagauagaauauucauuaguuc

SEQ ID NO: 2121 - RNA, 56 nt, Vaccinia virus
gaugauaauaaugaauugguguuaaauuuuaaagaguacacaauuucuauuauuac

SEQ ID NO: 2122 - RNA, 58 nt, Vaccinia virus
caacgaaauucuccagaagauguuacgauguuuagguuaggacauuugauuucgucgg

SEQ ID NO: 2123 - RNA, 55 nt, Vaccinia virus
aagaaaccguuagaucuauuauaacagaugcgguauccauugaacaagaauuucu

SEQ ID NO: 2124 - RNA, 58 nt, Vaccinia virus
aauucguuuauuaauaucgggaaauguauaaacuaaaacauugcccggaagcggagcu

SEQ ID NO: 2125 - RNA, 55 nt, Vaccinia virus
caaauugcauaccuauaggaauagucucuguaaucacugcgauuguauuauccgg

SEQ ID NO: 2126 - RNA, 56 nt, Vaccinia virus
uagauauaauaaacaaucucuaguaucuuuacugcuagaauccgguucagauguca

SEQ ID NO: 2127 - RNA, 55 nt, Vaccinia virus
aaugauuuuguagaugccauaucauacaugauauucaugucccuauuauaaucau

SEQ ID NO: 2128 - RNA, 59 nt, Vaccinia virus
gaugauauacaggcaauuauggaaucugauucguuuuuaaaguauaguagaucaaaacc

SEQ ID NO: 2129 - RNA, 58 nt, Vaccinia virus
uauggguaaaguuuuuguccccgcuccuuuuggaggaucgcaagaauuuauuucuaaa

SEQ ID NO: 2130 - RNA, 57 nt, Vaccinia virus
uaaacauaagggaaugucauuuguauuuuauaagccaaagcauucuaccguuguuaa

SEQ ID NO: 2131 - RNA, 56 nt, Vaccinia virus
aauuguuauauaguguaacacgaaugcaguuugggaguauucguugugcuacaaau

SEQ ID NO: 2132 - RNA, 58 nt, Vaccinia virus
uauacaguauaggaaaggagugcauagauaauauauacgaagacaaccauaccguaga

SEQ ID NO: 2133 - RNA, 58 nt, Vaccinia virus
caaauucuauugaguauauucuauccuucaucaacaaggaaagcauauauagaaugag

SEQ ID NO: 2134 - RNA, 55 nt, Vaccinia virus
aaacuucucuaaaugagucuacugcuagaaaaccucaucgaagaagauaccauau

SEQ ID NO: 2135 - RNA, 57 nt, Vaccinia virus
uaaauggguguugccaaugauucauccccugaauaucaauggaugucuccccauaga

SEQ ID NO: 2136 - RNA, 56 nt, Vaccinia virus
caauaaauuuauucucucuaugacuucaucaucuguucccgagagauaauauagag

SEQ ID NO: 2137 - RNA, 59 nt, Vaccinia virus
uaaauuuuagaaauaacauuagcgaauuguugugcauugaugucguuauucugaaacag

SEQ ID NO: 2138 - RNA, 64 nt, Vaccinia virus
aaaaaaauaauaauaucauuuacaauuaauaguauaaacuaaaaauuaaacaaaucguuauuau

SEQ ID NO: 2139 - RNA, 58 nt, Vaccinia virus
gaaaacaaugaacucggauguccuccaacauauacuaauugaguauaugacauucggc

SEQ ID NO: 2140 - RNA, 55 nt, Vaccinia virus
aaaaaugucuaguguaucuagaugaaaauguguuaucgagugauauauuagaucu

SEQ ID NO: 2141 - RNA, 57 nt, Vaccinia virus
aaaaaugguacaaaaggaaaguuauauaucgcguuguguaaagucaccguaccuacu

SEQ ID NO: 2142 - RNA, 59 nt, Vaccinia virus
caaauuauuaauaauauauuuggucuguucuaugaucuaccgugucuuaucaauugaag

SEQ ID NO: 2143 - RNA, 60 nt, Vaccinia virus
aaacuaauaauauauuguuaauuguguaaauaauauaaaaauaacaauacaauauugaau

SEQ ID NO: 2144 - RNA, 60 nt, Vaccinia virus; identical to SEQ ID NO: 2143

SEQ ID NO: 2145 - RNA, 56 nt, Vaccinia virus
gaacaugauauuuucuguaccauuucaccaacaaguauagaaaugcgaaucuauau

SEQ ID NO: 2146 - RNA, 57 nt, Vaccinia virus
gaacauauuuaauucagaucuaaaaaauacauauauuagaaugaauacaacgaauac

SEQ ID NO: 2147 - RNA, 64 nt, Vaccinia virus
gaaccuucuggaaauaauuaucacauucuacaugcguauuguggaauuaaaggacuagaugaac

SEQ ID NO: 2148 - RNA, 61 nt, Vaccinia virus
uaaguaugaugucuauguacggcaaggcauuuaaucacgcaucuguaaaggaaucauucgg

SEQ ID NO: 2149 - RNA, 58 nt, Vaccinia virus
aaauaacaguaucauuuaaacauuuaacuugcgggguuaaucucacaacuuuacuguu

SEQ ID NO: 2150 - RNA, 57 nt, Vaccinia virus
aaauaguuuuacguuauuaaucaucacgguaucgccgucgcuagauaacgcuaaugu

SEQ ID NO: 2151 - RNA, 61 nt, Vaccinia virus
uaauauaugaggcuguaauacaucuguauaacaaaaaaacagagauauugauuuauucuga

SEQ ID NO: 2152 - RNA, 57 nt, Vaccinia virus
uaauucugcuauuucugggauauauuuaucugccaguauaacacaaauaguaauaca

SEQ ID NO: 2153 - RNA, 56 nt, Vaccinia virus
caccuaaaaguuuuaaaucuuugaaaaaaguuuauacauucuuuaaauuuuuagcg

SEQ ID NO: 2154 - RNA, 56 nt, Vaccinia virus
uacaggauauagaagaugaggcuagcaauaauguugaucacgacuauguauaucca

SEQ ID NO: 2155 - RNA, 62 nt, Vaccinia virus
uacauuaaaaucuacgaacuacccuguugcgacaacuuuuuacacgcagaucuuaaacccga

SEQ ID NO: 2156 - RNA, 57 nt, Vaccinia virus
uacauauuccuggagauacacuguuuaaaauuagcgagguauuuauucauaauaaga

SEQ ID NO: 2157 - RNA, 56 nt, Vaccinia virus
uacaccaaagauauucuuuaggccgacaacuauuacggcuaauguaucuaggggga

SEQ ID NO: 2158 - RNA, 56 nt, Vaccinia virus
uacaaaauguugauaauccuugaggcguacuacguccgaccccaucauuucaacag

SEQ ID NO: 2159 - RNA, 55 nt, Vaccinia virus
gacugaaauaaccgcgugauuauuuuuugguauaauucuacacggcaugguuucu

SEQ ID NO: 2160 - RNA, 58 nt, Vaccinia virus
uacuuacggcuacggcauuagaugagaaauuauuccuaauuaagaaaauggcugaaca

SEQ ID NO: 2161 - RNA, 57 nt, Vaccinia virus
uaguagaaauauuuaagcacuugguauucuuuugccaagaaaacacuccuucuaaga

SEQ ID NO: 2162 - RNA, 58 nt, Vaccinia virus
aaggugauuggaaugggauaaauacaacaauuauauuuuuuaucauauccuucacgcu

SEQ ID NO: 2163 - RNA, 60 nt, Vaccinia virus
aagaaucguuaaauaccggauacguauucugauuaauaauguguuuaguaaguuggaugu

SEQ ID NO: 2164 - RNA, 57 nt, Vaccinia virus
gauggcguuuaaauauagacauuaucaaugccauaauaucuaaugugcuuagcuccc

SEQ ID NO: 2165 - RNA, 60 nt, Vaccinia virus
aauuaguucaacuucauacuaauugguuuaaugauuaccaaacaauguugauguuuaucu

SEQ ID NO: 2166 - RNA, 57 nt, Vaccinia virus
aauauuaugauauguuuacuaaagaugagacuccaaaguguaacguaacucauaagu

SEQ ID NO: 2167 - RNA, 60 nt, Vaccinia virus
aauaacauguaacgagauuuuauauacucuaguaauagguuggaauagucucuauguaau

SEQ ID NO: 2168 - RNA, 61 nt, Vaccinia virus
uauaaagugcacguuuacauaucuacguucuggaggaguaagaacgugacuauugagacga

SEQ ID NO: 2169 - RNA, 55 nt, Vaccinia virus
cauaauucguucuguauuauucuuaaacgauaagaguggccgcuugacggucaag

SEQ ID NO: 2170 - RNA, 56 nt, Vaccinia virus
gauaauauuaaaagauggauauaaagaauuugcugacugcauguacuauuuuuuac

SEQ ID NO: 2171 - RNA, 57 nt, Vaccinia virus
aauaguauuauuaacggaaacagcggacacauugcuuuuuuuauaauuuaucggugu

SEQ ID NO: 2172 - RNA, 64 nt, Vaccinia virus
aauauaaugauauauauuuucacuuuaucucauuugagaauaaaaauguuuuuguuuaaccacu

SEQ ID NO: 2173 - RNA, 57 nt, Vaccinia virus
aauaucgauauaaaaaaaauaacugauuuacucaacaguaguauuuuauucccagau

SEQ ID NO: 2174 - RNA, 60 nt, Vaccinia virus
aauccaauuguuugauauauaauuuaccgcuauagcauuguuauguauuucauuguucau

SEQ ID NO: 2175 - RNA, 56 nt, Vaccinia virus
aaucaucuaucugucuagauuauauuauagugaauaaucaggaauccaacaaauau

SEQ ID NO: 2176 - RNA, 58 nt, Vaccinia virus
uauccauacuguauguugcuacauguagguauuccuuuauccaauaauaguuuaaaca

SEQ ID NO: 2177 - RNA, 57 nt, Vaccinia virus
cauguuauagauguggauguacggcuuuacaugaguacuuuuauaauuauagaucag

SEQ ID NO: 2178 - RNA, 60 nt, Vaccinia virus
gauguuuaucuucuuccagcguauauagucuaauagcgauucaaacgcgugauaguuuau

SEQ ID NO: 2179 - RNA, 55 nt, Vaccinia virus
uauuugucauuuuauauuuguuggcuguaugcggauguaucgaauacgacguaga

SEQ ID NO: 2180 - RNA, 61 nt, Vaccinia virus
gauuuauauaaauucuucaaaguuugcguguguuuuaaaacuacauagaucaauguaucgc

SEQ ID NO: 2181 - RNA, 67 nt, Vaccinia virus
gauuaaaauaauaguuuugcuagaugaacgagggaaaagaaaucugggagagcuacaaagucacugc

SEQ ID NO: 2182 - RNA, 55 nt, Vaccinia virus
cauucaucaauaaugacgcauauucuacucuuggaauuaauaguuuugauauuag

SEQ ID NO: 2183 - RNA, 57 nt, Vaccinia virus
uauuuuauagcuaugcgauuggauaagaaaacauaucugccgcaagcuauuaggcga

SEQ ID NO: 2184 - RNA, 55 nt, Vaccinia virus
uauuuuacuagaguuacuaagagagacgaaucgucaaucuaugugauucuaaagg

SEQ ID NO: 2185 - RNA, 58 nt, Vaccinia virus
ucaccgcauugguguuccgauuuuaguaauauggaauaguguuagauaaaugcgguaa

SEQ ID NO: 2186 - RNA, 55 nt, Vaccinia virus
ucgguauuauauuauuaggaucuacguucauauguaucauaauauuaaucaucca

SEQ ID NO: 2187 - RNA, 57 nt, Vaccinia virus
ucaaugcacucuugaagauuuuuaccaauaauauguagcggauucucaaaguauuua

SEQ ID NO: 2188 - RNA, 55 nt, Vaccinia virus
ucuauugccaaauuuuugaaaauauuuauuuauaugcuuaaaucuauauaaugua

SEQ ID NO: 2189 - RNA, 58 nt, Vaccinia virus
gcuucuuuagucaauggauauucgaacauuaaccguuucaucaucauuggacagaauc

SEQ ID NO: 2190 - RNA, 56 nt, Vaccinia virus
ucaucauuguguaaacuaaauaacgucuucuauguauuuaguaaggacauuggaua

SEQ ID NO: 2191 - RNA, 60 nt, Vaccinia virus
ucauccuuuagagaaaagucgcgugcaaccauccaaagauuuucaucucuuagacgagaa

SEQ ID NO: 2192 - RNA, 59 nt, Vaccinia virus
ucacagauauuuccaugucauuguauaaagacuugauagcuauggagaaucucaaagcg

SEQ ID NO: 2193 - RNA, 61 nt, Vaccinia virus
ucacauuguauauaguuuauaaccuuaacuuucgagguuauugguuguggaucuucuacaa

SEQ ID NO: 2194 - RNA, 64 nt, Vaccinia virus
acagcaauagaucggaugauuuacuaaagucaucaaugguguccguuaguauaucaaagaucuu

SEQ ID NO: 2195 - RNA, 62 nt, Vaccinia virus
acaugccuaguaauagucucuuugcguugacggaaagcagacuagaaauaacaggcuaaaau

SEQ ID NO: 2196 - RNA, 61 nt, Vaccinia virus
ucaucagacaugauauuacuggauuuauauuguuuauggguaagguggaaucuccuuaaua

SEQ ID NO: 2197 - RNA, 66 nt, Vaccinia virus
acauggauuggagaucacuaacucaggucaaagaauuggguauugcgaucuucaauaauaggaacu

SEQ ID NO: 2198 - RNA, 59 nt, Vaccinia virus
uccauugccuucaguuaucaauccuucacuugcaguugggagaugaacacugcaaucag

SEQ ID NO: 2199 - RNA, 56 nt, Vaccinia virus
ucccguuuaauaucgcauuugucaagauaauaauagagugugguauguucacgaua

SEQ ID NO: 2200 - RNA, 59 nt, Vaccinia virus
cccauggucauagagaacggaauacuaaagaaacugucaucuauaaaauccaagaguag

SEQ ID NO: 2201 - RNA, 57 nt, Vaccinia virus
accaugacacuaaguugcaacggcgaaacaaaauauuuucguugcgaagaaaaaaau

SEQ ID NO: 2202 - RNA, 65 nt, Vaccinia virus
gcccgcuccauauaauaucugcguuuacguuacuagcaauaaaugcauuaauauugggacauacc

SEQ ID NO: 2203 - RNA, 64 nt, Vaccinia virus
gccucuuaucaagauauucucccuugucacaugacccguugguggcggaguagguauaucugcc

SEQ ID NO: 2204 - RNA, 59 nt, Vaccinia virus
ucguuaucgguuuucuacacucaccugguuuauaaacgugugcgagacacaaauaauaa

SEQ ID NO: 2205 - RNA, 57 nt, Vaccinia virus
gcggcuaauugcuucggccaacauguuacuauagcauuaaugucguacaaagguauc

SEQ ID NO: 2206 - RNA, 60 nt, Vaccinia virus
ucgguccacguguauuacuauaauaggauacgauucuauuauaugguauaaagauauaaa

SEQ ID NO: 2207 - RNA, 56 nt, Vaccinia virus
acuuuccugccgaauuuagagauggauauguggcaucuucauuagugggaaucaau

SEQ ID NO: 2208 - RNA, 57 nt, Vaccinia virus
ucucuuucucucuucgauggucucacaaaaauauuaaaccucuuucugauggagucg

SEQ ID NO: 2209 - RNA, 57 nt, Vaccinia virus; identical to SEQ ID NO: 2208

SEQ ID NO: 2210 - RNA, 57 nt, Vaccinia virus; identical to SEQ ID NO: 2208

SEQ ID NO: 2211 - RNA, 57 nt, Vaccinia virus; identical to SEQ ID NO: 2208

SEQ ID NO: 2212 - RNA, 57 nt, Vaccinia virus; identical to SEQ ID NO: 2208

SEQ ID NO: 2213 - RNA, 57 nt, Vaccinia virus; identical to SEQ ID NO: 2208

SEQ ID NO: 2214 - RNA, 57 nt, Vaccinia virus; identical to SEQ ID NO: 2208

SEQ ID NO: 2215 - RNA, 57 nt, Vaccinia virus; identical to SEQ ID NO: 2208

SEQ ID NO: 2216 - RNA, 57 nt, Vaccinia virus; identical to SEQ ID NO: 2208

SEQ ID NO: 2217 - RNA, 57 nt, Vaccinia virus; identical to SEQ ID NO: 2208

SEQ ID NO: 2218 - RNA, 57 nt, Vaccinia virus; identical to SEQ ID NO: 2208

SEQ ID NO: 2219 - RNA, 57 nt, Vaccinia virus; identical to SEQ ID NO: 2208

SEQ ID NO: 2220 - RNA, 57 nt, Vaccinia virus; identical to SEQ ID NO: 2208

SEQ ID NO: 2221 - RNA, 57 nt, Vaccinia virus; identical to SEQ ID NO: 2208

SEQ ID NO: 2222 - RNA, 57 nt, Vaccinia virus; identical to SEQ ID NO: 2208

SEQ ID NO: 2223 - RNA, 57 nt, Vaccinia virus; identical to SEQ ID NO: 2208

SEQ ID NO: 2224 - RNA, 57 nt, Vaccinia virus; identical to SEQ ID NO: 2208

SEQ ID NO: 2225 - RNA, 57 nt, Vaccinia virus; identical to SEQ ID NO: 2208

SEQ ID NO: 2226 - RNA, 57 nt, Vaccinia virus; identical to SEQ ID NO: 2208

SEQ ID NO: 2227 - RNA, 57 nt, Vaccinia virus; identical to SEQ ID NO: 2208

SEQ ID NO: 2228 - RNA, 57 nt, Vaccinia virus; identical to SEQ ID NO: 2208

SEQ ID NO: 2229 - RNA, 57 nt, Vaccinia virus
ucuaccguuuuguucuuggaugucauauaggaaacuauaaaguccgcacuacuguua

SEQ ID NO: 2230 - RNA, 97 nt, Vaccinia virus
ucuaucgauaauuguuucauauguuuuaauauuuacaaguuuuuugguccaugguacauuagccggacaaauauaugcaaaauaauaucguucucca

SEQ ID NO: 2231 - RNA, 60 nt, Vaccinia virus
ucuauuaagcgauuucauuuauuaauguacaaaaauaaauauuaguucauuguuuuaaca

SEQ ID NO: 2232 - RNA, 61 nt, Vaccinia virus
acucucuucccucuaucauguucacuacugguguccacgaugauaaauaucuagagggaau

SEQ ID NO: 2233 - RNA, 56 nt, Vaccinia virus
ucucuuucuccuucgauggucucacaaaaauauuaaaccucuuucugauggagucg

SEQ ID NO: 2234 - RNA, 56 nt, Vaccinia virus; identical to SEQ ID NO: 2233

SEQ ID NO: 2235 - RNA, 56 nt, Vaccinia virus; identical to SEQ ID NO: 2233

SEQ ID NO: 2236 - RNA, 56 nt, Vaccinia virus
acuuauagauagauaguacauaaaugcguauaguagucuaccuaucucuuuauuau

SEQ ID NO: 2237 - RNA, 56 nt, Vaccinia virus
ucuuucauccuuugacaucauucuaaauuuuugaaccgauucacauacguuacuaa

SEQ ID NO: 2238 - RNA, 58 nt, Vaccinia virus
agauuuuaucaauauuagauugugugccuacgagaaggaauauugcaaugacggauau

SEQ ID NO: 2239 - RNA, 56 nt, Vaccinia virus
uguagcuguuggaaccggcuguggaguuauaugaauaguugguuguagcgguugga

SEQ ID NO: 2240 - RNA, 57 nt, Vaccinia virus
uguguuuagaaaaucuaauaacuugaaagagauaauagaaaaugcaucuaaacaaaa

SEQ ID NO: 2241 - RNA, 56 nt, Vaccinia virus
aggauauuucaucuccguaaauauaugcucauauauuuauagaagauaucacauau

SEQ ID NO: 2242 - RNA, 57 nt, Vaccinia virus
gguauuacccggauacguggauaucauauauggcauugguccauuaucaguaauagc

SEQ ID NO: 2243 - RNA, 57 nt, Vaccinia virus
cguauauagauacuauagaaguguacaaucaucacacuuauucauggaauauauggg

SEQ ID NO: 2244 - RNA, 55 nt, Vaccinia virus
ugaugcacuuacuguauuaaugcuaucacuaguguaugugacggugucuguauga

SEQ ID NO: 2245 - RNA, 56 nt, Vaccinia virus
ugucauucucguuuuuauagaguguacucguuacuaaauauuaauuaaugaaauaa

SEQ ID NO: 2246 - RNA, 56 nt, Vaccinia virus
agguagagauggaaguugauccaccaacgaucuuaucacauucuuaucuacaauau

SEQ ID NO: 2247 - RNA, 57 nt, Vaccinia virus
cgucccuuaauaggcaguaggcuauuaucuucuuuacguaguaaucgucguagggag

SEQ ID NO: 2248 - RNA, 56 nt, Vaccinia virus
agauagaagcgauggauacuuucuaaaaauaaaaguuaccgcggcuaguccuaugu

SEQ ID NO: 2249 - RNA, 58 nt, Vaccinia virus
ggagguaaauaggcuaaagacuagaaucaggaaucuuaaacgaucgcuagagaucugc

SEQ ID NO: 2250 - RNA, 58 nt, Vaccinia virus
agucaauguuuuaaaauauauggacaagaauuugucuguauaaaaacuugugugaaau

SEQ ID NO: 2251 - RNA, 58 nt, Vaccinia virus; identical to SEQ ID NO: 2250

SEQ ID NO: 2252 - RNA, 56 nt, Vaccinia virus
cgacggggaugaugaaccuaugguacaaguugaagcugguaaaguaaaucauagug

SEQ ID NO: 2253 - RNA, 58 nt, Vaccinia virus
ggaaucguuggagauagugucuuccuuauguagaggauuugaaauaucuuaugaugac

SEQ ID NO: 2254 - RNA, 57 nt, Vaccinia virus
ggagcguaugaaauugucgauauuaaagaauuuaaacccgaaaaugaauugcgugac

SEQ ID NO: 2255 - RNA, 56 nt, Vaccinia virus
ggagaggcguaaaaucccuuagguaucagaaacuuaaaggaugaucccgguucaac

SEQ ID NO: 2256 - RNA, 58 nt, Vaccinia virus
ggaauaaaauaaaacagggauucguuuacucucagaaacagaaacuugcaaagaagac

SEQ ID NO: 2257 - RNA, 66 nt, Vaccinia virus
ugacuuauuuuuuacuaccuaaauggauagcaccaaugugcguuccggaaugaagagccgcaaaaa

SEQ ID NO: 2258 - RNA, 60 nt, Vaccinia virus
cgaguauguuuuuguagaugagagguuuucuacuugcucauuagaaguauaaaaaaauag

SEQ ID NO: 2259 - RNA, 61 nt, Vaccinia virus
ggauauaaaaguccuugauccauugaucuggaaacgggcaucuccauuuaagacuagacgc

SEQ ID NO: 2260 - RNA, 58 nt, Vaccinia virus
agcaccguuuccaaaaucaaucgccaauaccuuucguuuguuggaaucgucuaaaaau

SEQ ID NO: 2261 - RNA, 56 nt, Vaccinia virus
agguggaggaauuuauagaugcuggaagacaaguuagaugguguucuacauccaau

SEQ ID NO: 2262 - RNA, 58 nt, Vaccinia virus
uggccucucuguuaacguaaugguaaucaacaccuucucguuccauaggacgaggaaa

SEQ ID NO: 2263 - RNA, 58 nt, Vaccinia virus
uggaauauggcucaaaaaaacuaucuaccgcauagauaguuuuuuuuagaucggauaa

SEQ ID NO: 2264 - RNA, 56 nt, Vaccinia virus
cgguguguugucuaacguauuggacaugcuuauguacguagaagaaaauaaugaag

SEQ ID NO: 2265 - RNA, 55 nt, Vaccinia virus
cguuuaugacaccauaggcauugguuaacgaaugccgugaguguaauaauuugag

SEQ ID NO: 2266 - RNA, 57 nt, Vaccinia virus
cguaaacggauggguaaaaaagggagggcauguaacccuuuuuaucgauagaggaag

SEQ ID NO: 2267 - RNA, 57 nt, Vaccinia virus
aguauuuuauagaguaaaacaaauuaguauuucuacggguguucuauauaaaucuau

SEQ ID NO: 2268 - RNA, 59 nt, Vaccinia virus
ugucaucaugaacggcggacauauucaguugauaaucggccccauguuuucagguaaaa

SEQ ID NO: 2269 - RNA, 63 nt, Vaccinia virus
ugucgaguguuacaugauggguauagaauacggacuauccaaucucuuaugucauacuaaaaa

SEQ ID NO: 2270 - RNA, 66 nt, Vaccinia virus
aguuuucccauacuaauugguuacuauuauuuuucguauaauuuuuaacaguuugagguuuuagau

SEQ ID NO: 2271 - RNA, 56 nt, Vaccinia virus
uuaauaaaacagaguuagugucuaaaauucuuugugcaauauuaaacaguuuauua

SEQ ID NO: 2272 - RNA, 57 nt, Vaccinia virus
augauucaguaaacgaauaauuucugaaauaaauucaggcuuaacuauaugaguuuu

SEQ ID NO: 2273 - RNA, 60 nt, Vaccinia virus
aucaggaauccaaagagcuauaaauagaucucugguucuauguuccucguuuccuguauu

SEQ ID NO: 2274 - RNA, 56 nt, Vaccinia virus
uuucauccgauaacauguuaauuuccgacaccaacgguuuuaauauuucgaugaua

SEQ ID NO: 2275 - RNA, 58 nt, Vaccinia virus
auugucguuguaugaguaugaucuuuuaaacccgcuagacaaguauccguuugauauu

SEQ ID NO: 2276 - RNA, 57 nt, Vaccinia virus
uuaaugauacacacuacacugucgaauuugauagggacaaaguaguugacacguuua

SEQ ID NO: 2277 - RNA, 58 nt, Vaccinia virus
uucucuuucucucuucgauggucucacaaaaauauuaaaccucuuucugauggagucg

SEQ ID NO: 2278 - RNA, 58 nt, Vaccinia virus; identical to SEQ ID NO: 2277

SEQ ID NO: 2279 - RNA, 58 nt, Vaccinia virus
guauugcgcaucgauaucuuuauuauuagauaaauuuaucaauaaaugugagaaguuu

SEQ ID NO: 2280 - RNA, 57 nt, Vaccinia virus
guauuucuguggauuaauagauuucuaguauggggaucauuaaucaucucuaaucuc

SEQ ID NO: 2281 - RNA, 55 nt, Vaccinia virus
guaguuucuaauaugaggaaaaugaucgaaucaaaacguccucuauacauuacuc

SEQ ID NO: 2282 - RNA, 58 nt, Vaccinia virus
cuagacaccuuuucaauguuuaauuuuuuugaaauaagcuuugauaaagccuuccucg

SEQ ID NO: 2283 - RNA, 57 nt, Vaccinia virus
guagucaaauuuguaguacuugguuuuaauuccagaguuuaauuuguuguaucuuuc

SEQ ID NO: 2284 - RNA, 55 nt, Vaccinia virus
uuauuuuguuuauucuguucuuugcauaugugaugaacaucgaaagacaggacua

SEQ ID NO: 2285 - RNA, 62 nt, Vaccinia virus
guaucaaggaggaugaaaccguuaguaccauagaugguagaaucgucacucuacagaaaguc

SEQ ID NO: 2286 - RNA, 60 nt, Vaccinia virus
auaaugugcauaguagaauccuugaauauuuucacacauguucuauuaguaaaaauaauu

SEQ ID NO: 2287 - RNA, 56 nt, Vaccinia virus
uuaagugcaaguacggauauaaacuaucugguuccucaucaucuacuugcucucca

SEQ ID NO: 2288 - RNA, 58 nt, Vaccinia virus
uuaaaaacugauauaacuccgguagaagcuccgcuuccgggcaauguuuuaguuuaua

SEQ ID NO: 2289 - RNA, 57 nt, Vaccinia virus
uuagaggugauguaaucguuaguuauaaaaauagugacuuaguuucaucauuuaaug

SEQ ID NO: 2290 - RNA, 57 nt, Vaccinia virus
uuagauguaaugguaacgauaacacaaaaugugaacgcugcccaccucauacauaua

SEQ ID NO: 2291 - RNA, 55 nt, Vaccinia virus
guagaauuggacacucuggcagccgaaauagcagccacuuguacuacacaacauc

SEQ ID NO: 2292 - RNA, 58 nt, Vaccinia virus
uuaugggcauuuguauuuugauaggaucuauaauguaguaaauauaaaauauaauccg

SEQ ID NO: 2293 - RNA, 59 nt, Vaccinia virus
uuauaauguuaccaauccguuugauuucauggaaaauauaucauuggaaggaaaaacua

SEQ ID NO: 2294 - RNA, 67 nt, Vaccinia virus
uuauauuaucaugaauaaaaauaguagcacgcacuacuucagccaaauauucuuuuuugaaacgcca

SEQ ID NO: 2295 - RNA, 64 nt, Vaccinia virus
auaucccaaacauucucugcuuaaaucaaaugcugauugguuuuuuauuuuucguuuuacaguu

SEQ ID NO: 2296 - RNA, 55 nt, Vaccinia virus
auaugguaucuucuucgaugagguuuucuagcaguagacucauuuagagaaguuu

SEQ ID NO: 2297 - RNA, 58 nt, Vaccinia virus
cucauucuauauaugcuuuccuuguugaugaaggauagaauauacucaauagaauuug

SEQ ID NO: 2298 - RNA, 60 nt, Vaccinia virus
gucuuagcgcaucagauguugauauggauuuugauuuaaacauuuuuaugacguugguuc

SEQ ID NO: 2299 - RNA, 55 nt, Vaccinia virus
uucuuuuguauucgguaguucaaauauaugauccaugcauagaucggcaaagcua

SEQ ID NO: 2300 - RNA, 56 nt, Vaccinia virus
gucccaauauuaaugcauuuauugcuaguaacguaaacgcagauauuauauggagc

SEQ ID NO: 2301 - RNA, 56 nt, Vaccinia virus
uucaaauuugcauaauuaacgauggcuauacgcuuauuaacuucuguugauuuaua

SEQ ID NO: 2302 - RNA, 56 nt, Vaccinia virus
uuccgacgcaauagugaaacaugauagaauacauaaaaccauagaaucaguugaug

SEQ ID NO: 2303 - RNA, 57 nt, Vaccinia virus
uuccgcuugggaauuuuuuaacgcuaaagaguuaacguuaaucgugcacccaacgua

SEQ ID NO: 2304 - RNA, 56 nt, Vaccinia virus
cucuauauuaucucucgggaacagaugaugaagucauagagagaauaaauuuauug

SEQ ID NO: 2305 - RNA, 60 nt, Vaccinia virus
auccauuacgauucuaguuucaaaaacauugacucucuuuuugaauccucguaguuuguu

SEQ ID NO: 2306 - RNA, 64 nt, Vaccinia virus
auccuguuucaaaguaacuuauaucaucuuuauaauaugaucugauauacucacaaauuuucuu

SEQ ID NO: 2307 - RNA, 59 nt, Vaccinia virus
uucuuuccauaguacauaguuguugcggugcagaagcaauaaauacagaguguggaacg

SEQ ID NO: 2308 - RNA, 58 nt, Vaccinia virus
uucuccucguuugucaaucauguuaaugucuuuaagauaagguaggcaaauguuuaua

SEQ ID NO: 2309 - RNA, 56 nt, Vaccinia virus
uugaaugagauacuaacacauuucaacaauaaugagaauguuacauuauuuuauug

SEQ ID NO: 2310 - RNA, 59 nt, Vaccinia virus
gugcaagaauucaccauguugguuaacuuacuacgaccaggauccuuacaacaccaauc

SEQ ID NO: 2311 - RNA, 59 nt, Vaccinia virus
auuucuuugguaaugaaauuauucacaauaucaguaucuucuuuaucuaccagagauuu

SEQ ID NO: 2312 - RNA, 57 nt, Vaccinia virus
uuuuguuuagaugcauuuucuauuaucucuuucaaguuauuagauuuucuaaacaca

SEQ ID NO: 2313 - RNA, 60 nt, Vaccinia virus
uuuaugaucauuuuuaacagcaacacauucaauauuguauuguuauuuuuauauuauuua

SEQ ID NO: 2314 - RNA, 55 nt, Vaccinia virus
uuuauuuucauuuuuuaaguauagaauaaagaaucuauaaaaacuaaaaaaauua

SEQ ID NO: 2315 - RNA, 57 nt, Vaccinia virus
uuuucuauaaucauuuuagcuauuucggcaucauccaauaguacauuuuccagauua

SEQ ID NO: 2316 - RNA, 55 nt, Vaccinia virus
uuucuccagagaauaaggcauuuaagaauaaucugaguagauuuaucgagagugg

SEQ ID NO: 2317 - RNA, 58 nt, Vaccinia virus
auuucacacaaguuuuuauacagacaaauucuuguccauauauuuuaaaacauugacu

SEQ ID NO: 2318 - RNA, 58 nt, Vaccinia virus; identical to SEQ ID NO: 2317

SEQ ID NO: 2319 - RNA, 55 nt, Vaccinia virus
auugacuuugaucgaugaaggcuccccugucugcagccauuuuuaugaucgucuu

SEQ ID NO: 2320 - RNA, 63 nt, Vaccinia virus
auuagaucugcauucauuauuauagaaucuuucuuccacuaauauucuaauaagauuaaguuu

SEQ ID NO: 2321 - RNA, 61 nt, Vaccinia virus
uuuaaagagaaaucaguuuaggaagaaaaaaauuaucuaucuacaucaucacgucucugua

SEQ ID NO: 2322 - RNA, 58 nt, Vaccinia virus
uuuaaugagaaacuuaaaguagacuccgauucgggacuauuugacuuugucaacuuug

SEQ ID NO: 2323 - RNA, 56 nt, Vaccinia virus
uuuauguauccuaguuucaaugucucguaaugaguuugugcugcucuuauugucug

SEQ ID NO: 2324 - RNA, 74 nt, Vaccinia virus
guuaugacuccaauuaaucccauguuagcggaaucgugugauucugucaauaaggcguuuaaaaaauuuccauc

SEQ ID NO: 2325 - RNA, 59 nt, Vaccinia virus
cuucaauugauaagacacgguagaucauagaacagaccaaauauauuauuaauaauuug

SEQ ID NO: 2326 - RNA, 55 nt, Vaccinia virus
uuucuuugacuugaauacuauccgaucacaaauauccacuaguuuagauucaaca

SEQ ID NO: 2327 - RNA, 62 nt, Vaccinia virus
cuucuccaaucauauagauauuuucuuucuaucauggauaauauuuguaaugguucuuuucg

SEQ ID NO: 2328 - RNA, 63 nt, Vaccinia virus
auucuccauagcuaucaagucuuuauacaaugacauggaaauaucugugaauacuuuauacuu

SEQ ID NO: 2329 - RNA, 55 nt, Vaccinia virus
uuucugaacguugauagucuacuaauacuacaugcugacaucuaaugccuguaua

SEQ ID NO: 2330 - RNA, 55 nt, Vaccinia virus; identical to SEQ ID NO: 2329

SEQ ID NO: 2331 - RNA, 58 nt, Vaccinia virus
uuucuuuaucgcuaucuucaucauauucaucaucaauaucaacaagucccagauuacg

SEQ ID NO: 2332 - RNA, 64 nt, Vaccinia virus
uuuucagauucggagauccuaugccauucgaagaagaacucauagaucacgaacaugugcaaua

SEQ ID NO: 2333 - RNA, 60 nt, Vaccinia virus
uuuuagccuguuauuucuagucugcuuuccgucaacgcaaagagacuauuacuaggcaug

SEQ ID NO: 2334 - RNA, 60 nt, Vaccinia virus
guuuagcaugauuucuggugauacgucaaucggaguaucaucuauuagagaucuaaagcc

SEQ ID NO: 2335 - RNA, 70 nt, Vaccinia virus
uuuuaaacagucuccucgauaauaagccauaucuggaaauuuauuaaauacucgagucauuuuacgcacg

SEQ ID NO: 2336 - RNA, 59 nt, Vaccinia virus
cuuuauuuccacauuagaugguaaauccaauagugaaacuaucuuuuuaggaauguaug

SEQ ID NO: 2337 - RNA, 58 nt, Vaccinia virus
uuuuuggccaaaaugauagauauuuuuuuauccgaggauaguaaaauauuauuagucg

SEQ ID NO: 2338 - RNA, 66 nt, Vaccinia virus
uuuuuauaauuucccaaauacacauuauugguuacccuugucauuauagugggagauuuggcucug

SEQ ID NO: 2339 - RNA, 56 nt, Vaccinia virus
uuuuucagaugccucuuuuaguuuaucaaaaauaagcgcuccccuagucguacuca

SEQ ID NO: 2340 - RNA, 59 nt, Vaccinia virus
uuuuucaccauuacuucuuccauguccaauaugaucaugugagaauacuaaaauuccua

SEQ ID NO: 2341 - RNA, 62 nt, Vaccinia virus
auuuuuuaugcuugcauuauuaaugguauguaauaugauugauuguguacgcaauaccaauu

SEQ ID NO: 2342 - RNA, 151 nt, Human herpesvirus 1
cguagccggugggcguggccgcuauuauaaaaaaagugagaacgcgaagcguucgcacuuuguccuaauaauauauauauuauuaggacaaagugcgaacgcuucgcguucucacuuuuuuuauaauagcggccacgcccaccggcugaug

SEQ ID NO: 2343 - RNA, 144 nt, Human herpesvirus 1
agccggugggcguggccgcuauuauaaaaaaagugagaacgcgaagcguucgcacuuuguccuaauaauauauauauuauuaggacaaagugcgaacgcuucgcguucucacuuuuuuuauaauagcggccacgcccaccggcu

SEQ ID NO: 2344 - RNA, 80 nt, Human herpesvirus 1
ugcugccgcccaccgauccccugcgcacacgggcccuggggauagccugcgcggccggggccucgauguggguggcggcg

SEQ ID NO: 2345 - RNA, 60 nt, Human herpesvirus 1
ggcacgcgcgauagagucgacgaccuggggacggacgucgacucuaucgcgcgcauuguc

SEQ ID NO: 2346 - RNA, 71 nt, Human herpesvirus 1
agcgcccggcggguccgcuguaacugcuguuguaggcgguaacaggcgcggaucaguaccgccagggcgcu

SEQ ID NO: 2347 - RNA, 72 nt, Human herpesvirus 1
guccugccugcuggcggcccuggccaaccggcugugcgggccggacacggccgccugggcgggcaauuggac

SEQ ID NO: 2348 - RNA, 58 nt, Human herpesvirus 1
ggauggccgggugguugaugguaccggccacguacucgcggcgcgccuggucguuguu

SEQ ID NO: 2349 - RNA, 69 nt, Human herpesvirus 1
cggcgcuguggccucccguuccgggcccccguguaaagguuggucaggugaggccacagcggcaccccg

SEQ ID NO: 2350 - RNA, 73 nt, Human herpesvirus 1
ggggcuccggcgucgccugcacaggaaggaccccggggacggggcccgguuggcggcgacgcuucggggccuc

SEQ ID NO: 2351 - RNA, 56 nt, Human herpesvirus 1
gggccgugccgacucgguuuuugcccgaguggaccguggcguggaccccguucccc

SEQ ID NO: 2352 - RNA, 55 nt, Human herpesvirus 1
caucgcgcccuuucgccaccugucgccggcgucucgcgagggggcgcggcgacug

SEQ ID NO: 2353 - RNA, 55 nt, Human herpesvirus 1
guucgcgggcgacgccccggccgccugguugcggcccgcguuuggccugcggcgc

SEQ ID NO: 2354 - RNA, 64 nt, Human herpesvirus 1
gcggccgugugggcgcccgagcugggcgacgccgcgcagcaguacgcccugaucacgcggcugc

SEQ ID NO: 2355 - RNA, 55 nt, Human herpesvirus 1
gggcgcgccgcugcggcccguguacguggcgcuggggcgcgaggcggugcgcgcc

SEQ ID NO: 2356 - RNA, 55 nt, Human herpesvirus 1
ccccgagccacgccagaaccuuggcaaaggucgacgggguggcguggcuucgggg

SEQ ID NO: 2357 - RNA, 72 nt, Human herpesvirus 1
guccccccaggccccuaggucgcgacggcucguaagcacgacgcggucggccgcggggcuuugcgggggggc

SEQ ID NO: 2358 - RNA, 80 nt, Human herpesvirus 1
ccgcccccgacgccuuuuuucacaccgcguaugcccuggccguccuggcacaccuggggggacggggcggucgggggcgg

SEQ ID NO: 2359 - RNA, 85 nt, Human herpesvirus 1
gccccgcauaucccacccuggagcucaaucuggcccaacagccgcuuuugcggguccagagggcaacgcgggacuaugccggggu

SEQ ID NO: 2360 - RNA, 59 nt, Human herpesvirus 1
gccugcuggcggcccuggccaaccggcugugcgggccggacacggccgccugggcgggc

SEQ ID NO: 2361 - RNA, 90 nt, Human herpesvirus 1
cgcguccagucuugcuaggcccguccggccguggggguccgccagcccgcuccccccgaggucggccagggccgccaggagcugggcgcg

SEQ ID NO: 2362 - RNA, 56 nt, Human herpesvirus 1
cccgcgagucggagcuggagcugugucucacgcuguuugacucacgcgcucgcggg

SEQ ID NO: 2363 - RNA, 59 nt, Human herpesvirus 1
gcggccgugcgggcgcaccgcguccuggucgacgcggugacggcccugggcgcggccgc

SEQ ID NO: 2364 - RNA, 81 nt, Human herpesvirus 1
accuguguggcgguugguccagacgcgggcgacgcacacacccuagcgugcguuacgugugccugccguccgaacgcgggu

SEQ ID NO: 2365 - RNA, 55 nt, Human herpesvirus 1
ggggggugcucugauagucucgcgugcccaaggcccgugaucgggguacuucgcc

SEQ ID NO: 2366 - RNA, 55 nt, Human herpesvirus 1
caucccuguuuuuaguccgcgcuuauaugcguggaccagaaggcggaccagggug

SEQ ID NO: 2367 - RNA, 77 nt, Human herpesvirus 1
ggggggcguggggaaucgcguagguggcgcagauguccuugauggccugcaggucguacguggcccccgcgcccccc

SEQ ID NO: 2368 - RNA, 81 nt, Human herpesvirus 1
gaagaggggggagaaaggggucugcaaccaaagguggucuggguccguccuuuggaucccgaccccucuucuucccucuuc

SEQ ID NO: 2369 - RNA, 55 nt, Human herpesvirus 1
gcgcgcgcgcgcaaaaaaggcgggcggcgguccgggcggcgugcgcgcgcgcggc

SEQ ID NO: 2370 - RNA, 89 nt, Human herpesvirus 1
gagaucugcgccgaggcggcggugggcaucagcgcgacaaacuggcuguugcgcaggccguguuucaucaugcucuggcguagcaucuc

SEQ ID NO: 2371 - RNA, 69 nt, Human herpesvirus 1
ggccagguccugucgggucacgaaugcgacguagugcgcguacgccguguccuucacggggcucugguc

SEQ ID NO: 2372 - RNA, 99 nt, Human herpesvirus 1
gauccagccccagcuucaggcaggccgugugcaggcccugcaugccgauucccauggaccgcagguugucguugccgcgggugcacuggggcguggguu

SEQ ID NO: 2373 - RNA, 55 nt, Human herpesvirus 1
gggggggggggggggggcgggaaaccaaguaggcccgcccauccgcggccccucc

SEQ ID NO: 2374 - RNA, 121 nt, Human herpesvirus 1
ccggggccgcgggggccuuagucgccacccgcuggguucggggggcccggggggcgguggugggugugcguccggccccuccggacccagcggguggcggaggcgcccgcgcaggccccgg

SEQ ID NO: 2375 - RNA, 56 nt, Human herpesvirus 1
gccauggcggccggccgcuucggcuggggccuggcgcacgcggcggccgccguggc

SEQ ID NO: 2376 - RNA, 106 nt, Human herpesvirus 1
cgucuccccgggggaaaacaggauagcuuccggagucuccauacgcacggucaccccacgcacaugugagacuucgggggcgcugggccaagaccucgggggggcg

SEQ ID NO: 2377 - RNA, 56 nt, Human herpesvirus 1
gugccgcacgcggugggggccgaaccggacacaggcaaccccgacgugcguugcac

SEQ ID NO: 2378 - RNA, 89 nt, Human herpesvirus 1
gccgugugccccagucgcacucgucccuggcucaggccgcgaaccaagaacagagucugugccgggcgcgugcgacgguggcgcgcggc

SEQ ID NO: 2379 - RNA, 89 nt, Human herpesvirus 1; identical to SEQ ID NO: 2378

SEQ ID NO: 2380 - RNA, 84 nt, Human herpesvirus 1
ccgggggaugguaaggcgucgcggcguccuggaucgacgguaugugccaguuuggugggauuugcggcgccaccguccccacgg

SEQ ID NO: 2381 - RNA, 95 nt, Human herpesvirus 1
gcggggggugggaccugucgggaaaagauucagcgggcgcggcgcgacaacgagcccccgccccucccccgaccucgccuacacucgacccccgc

SEQ ID NO: 2382 - RNA, 70 nt, Human herpesvirus 1
gucugcugcagcagagccagcagccgcugcugggcgccggcggagggcugcuccccgagcugcagcaggc

SEQ ID NO: 2383 - RNA, 84 nt, Human herpesvirus 1
uggccccuggggauugguuagacccauggguugugguuauaugcacuuccuauaagacucucccccaccgcccacagagggcca

SEQ ID NO: 2384 - RNA, 141 nt, Human herpesvirus 1
ggcgggccgggccccggccagccccgggacggccgccaggucgccgucgaagcccucggccagcgccuccaggaucccgcggcaggcggccaggcacucgacggccacgcggccggccugggcgcggcgcccggcgucguc

SEQ ID NO: 2385 - RNA, 71 nt, Human herpesvirus 1
ggcccgagucugccuggcugcugcgucucgcuccgagugccgaggugcaaaugcgaccagacugucgggcc

SEQ ID NO: 2386 - RNA, 71 nt, Human herpesvirus 1; identical to SEQ ID NO: 2385

SEQ ID NO: 2387 - RNA, 55 nt, Human herpesvirus 1
cagggcguuguucuggucaaggagggucauuacguugacgacaacaacgcccaug

SEQ ID NO: 2388 - RNA, 60 nt, Human herpesvirus 1
gacgccccgcccgucacggggggcgcggcggcgccucugcgugggggggcgcggggcguc

SEQ ID NO: 2389 - RNA, 55 nt, Human herpesvirus 1
agcuuguuuucgugggggacgaggaggacgucuccaagcuuuccgagggcgagcu

SEQ ID NO: 2390 - RNA, 58 nt, Human herpesvirus 1
gccccccgggccuccggagaggcguccggagacgggccgcucggcggcccgggcgggc

SEQ ID NO: 2391 - RNA, 90 nt, Human herpesvirus 1
gggccagguagauguacguaaugaauucacggucggacacgcgcaggcaacugcgaucguggguuaugaacuucuccagcgcacuggucu

SEQ ID NO: 2392 - RNA, 64 nt, Human herpesvirus 1
gcugcccgcugauggggucucgcacgagccagucgccccggcggugguuguaguagauauacac

SEQ ID NO: 2393 - RNA, 69 nt, Human herpesvirus 1
ccucgauggccagguuguccgccguacaguuaaacucgacgucgcuggaugucccgaaggccaucgggg

SEQ ID NO: 2394 - RNA, 55 nt, Human herpesvirus 1
gucgguggggcccggggagccggggcgcugcuuguucuccgacgccaucgccgau

SEQ ID NO: 2395 - RNA, 61 nt, Human herpesvirus 1
uuguggggccccgggccggggccccuuggguccgccggggccccgggccgggccgccacgg

SEQ ID NO: 2396 - RNA, 56 nt, Human herpesvirus 1
ccgugugggcgcccgagcugggcgacgccgcgcagcaguacgcccugaucacgcgg

SEQ ID NO: 2397 - RNA, 55 nt, Human herpesvirus 1
acggggugcucccggcggccccgggggacgucccccgggacgcgaguacccacgu

SEQ ID NO: 2398 - RNA, 131 nt, Human herpesvirus 1
ggggcugaucgccugcgugcagcuggagcgcguccucgagacggccgccagcgcugcgauuuucgagcgccgcgggccgccgcucucccgggaggagcgccuguuguaccugaucaccaacuaccugcccu

SEQ ID NO: 2399 - RNA, 92 nt, Human herpesvirus 1
gucggggaccccgcggacgaaaaccccccgggggcucuucccgggcccccgggcggcccccgguaucgggucuuuguccuagggucccugac

SEQ ID NO: 2400 - RNA, 56 nt, Human herpesvirus 1
ucagcucuucggacgcuuugugcgccaccgccaggcgagauggggggccucgaugg

SEQ ID NO: 2401 - RNA, 188 nt, Human herpesvirus 1
uccccucgguuguuccucgccucccccaacaccccgccgcuuuccguugggguuguuauuguugucgggaucgugcgggccgggggucgccggggcaggggcgggggcgugggcgggggugcucgucgaucgaccgggcucagugggggcguggggugggugggagaaggcgaggagacugggguggg

SEQ ID NO: 2402 - RNA, 101 nt, Human herpesvirus 1
gggcgaccccggucccuguauauauagggucaggggguuccgcacccccuaacauggcgcccccggucccuguauauauagugucacgggguuccacgccc

SEQ ID NO: 2403 - RNA, 96 nt, Human herpesvirus 1
gggggcguggcugccgggaggggccgcggaugggcgggccuacuugguuucccgccccccccccccccccccgaaccgccccgccgcuuugccccc

SEQ ID NO: 2404 - RNA, 56 nt, Human herpesvirus 1
cuccguuggguuuucuuugugccuguacucaaaaggucauaccccguaaacggcgg

SEQ ID NO: 2405 - RNA, 65 nt, Human herpesvirus 1
cugcccccgaagccacgccaccccgucgaccuuugccaagguucuggcguggcucggggucgcgg

SEQ ID NO: 2406 - RNA, 56 nt, Human herpesvirus 1
gcccagcgcgaucuacgggagcugcggugccgggaucccgaggcgucgcugccggc

SEQ ID NO: 2407 - RNA, 55 nt, Human herpesvirus 1
ccggggugguaagguucgcgcugggcugccccaacgggaccggcgccaucuugag

SEQ ID NO: 2408 - RNA, 57 nt, Human herpesvirus 1
gucauagugcaaaaggggggaugcgcccgggcgggaagcuccuaagggcacuaugac

SEQ ID NO: 2409 - RNA, 58 nt, Human herpesvirus 1
uguccuccggaagggcccccaacacgauguuugugccgggcaaggucggcgggaugag

SEQ ID NO: 2410 - RNA, 56 nt, Human herpesvirus 1
guacgucgugaccuaccucgggggagaccuucccgaggagugcauggccguguacc

SEQ ID NO: 2411 - RNA, 73 nt, Human herpesvirus 1
ugcucgccgaaccccaugaccucgaggugcugguagagcuucucgaacuccuccccgugaaagucggcgagcg

SEQ ID NO: 2412 - RNA, 56 nt, Human herpesvirus 1
ggucuggguuaggaagggccaccugacacagaggcucggugaggaccguuagacac

SEQ ID NO: 2413 - RNA, 55 nt, Human herpesvirus 1
gugugcacggaugagaucgcgccccaccugcgcugcgacaccuucccgugcaugc

SEQ ID NO: 2414 - RNA, 55 nt, Human herpesvirus 1; identical to SEQ ID NO: 2413

SEQ ID NO: 2415 - RNA, 56 nt, Human herpesvirus 1
ggacgccgaucccgacuccccggaccuugacucuauguggucggcgucggugaucc

SEQ ID NO: 2416 - RNA, 56 nt, Human herpesvirus 1
ccucgcccggcagcggcgaguacagcaccaccacgcgcacguccucggggucgggg

SEQ ID NO: 2417 - RNA, 56 nt, Human herpesvirus 1; identical to SEQ ID NO: 2416

SEQ ID NO: 2418 - RNA, 56 nt, Human herpesvirus 1
gcgccucgcgcaguucuuccgggcgaccgcgaucuggaccggccccgcggggacgc

SEQ ID NO: 2419 - RNA, 55 nt, Human herpesvirus 1
uucccuggugcccggggcccaggauuccgccccgcccggccccacgcuaagggag

SEQ ID NO: 2420 - RNA, 58 nt, Human herpesvirus 1
cgggccggcuccgcgggccagggcccgggcacgggccucgggccccaggcacggcccg

SEQ ID NO: 2421 - RNA, 57 nt, Human herpesvirus 1
gucauagugcccuuaggagcuucccgcccgggcgcauccccccuuuugcacuaugac

SEQ ID NO: 2422 - RNA, 56 nt, Human herpesvirus 1
cgccccgcccgucacggggggcgcggcggcgccucugcgugggggggcgcggggcg

SEQ ID NO: 2423 - RNA, 55 nt, Human herpesvirus 1
agcugcccgugcguggauuuguggaagacgcggaagccgggacggaugggcgguu

SEQ ID NO: 2424 - RNA, 56 nt, Human herpesvirus 1
cguccucgccgacccgggcuucguccccuacguucuggcccugguggucggggacg

SEQ ID NO: 2425 - RNA, 56 nt, Human herpesvirus 1
gaucuuuggggagcagguguuccugccccuggaacacucgcaauucagucgguauc

SEQ ID NO: 2426 - RNA, 60 nt, Human herpesvirus 1
uguggggcgugacggaaccaccccgcgugccaucacggccaaggcgcgggaugcuccgca

SEQ ID NO: 2427 - RNA, 81 nt, Human herpesvirus 1
ccgcgggcgcgcuccugaccgcggguuccgaguugggcguggagguuaccugggacugugcgguugggacggcgcccgugg

SEQ ID NO: 2428 - RNA, 81 nt, Human herpesvirus 1
gccccccgcgggcgcgcgcgcgcgcaaaaaaggcgggcggcgguccgggcggcgugcgcgcgcgcggcgggcguggggggc

SEQ ID NO: 2429 - RNA, 81 nt, Human herpesvirus 1; identical to SEQ ID NO: 2428

SEQ ID NO: 2430 - RNA, 61 nt, Human herpesvirus 1
guggggguggucggggucguggucggggucguccccgcccuccuccgucuccgcgccccac

SEQ ID NO: 2431 - RNA, 58 nt, Human herpesvirus 1
ggggggcgggucuguugacaagggggcccguccggccccucggccgccccgccuccgc

SEQ ID NO: 2432 - RNA, 55 nt, Human herpesvirus 1
gcgggccuguuguuugucuugcucgucgccuuagcggcgggagacgcgggcccgc

SEQ ID NO: 2433 - RNA, 64 nt, Human herpesvirus 1
uuccguggcuuuuuguugccggcgagggcgcaacgccguacgucgguuguuauggccgcgagaa

SEQ ID NO: 2434 - RNA, 85 nt, Human herpesvirus 1
uccagcagcacgugcagcaucuggucggccgugccgcgcucaaacgccccgaggacggccuggacguugcgagcgagcuguugga

SEQ ID NO: 2435 - RNA, 122 nt, Human herpesvirus 1
cgcggggggagggggaaggaacgaaacacucucauucggaggcggcucgggguuuggucuugguggccacgggcacgcagaagagcgccgcgauccucuuaagcacccccccgcccuccgug

SEQ ID NO: 2436 - RNA, 56 nt, Human herpesvirus 1
cgcaggugcaugccccagguuccgccggacaccugcagcaaacggcaccacgugcg

SEQ ID NO: 2437 - RNA, 92 nt, Human herpesvirus 1
gucgccuccaucagcuggccccaggccucgcccagccgcucggucugccggccuggcggggcgcgcuggugggccaggugaggcaggucggc

SEQ ID NO: 2438 - RNA, 56 nt, Human herpesvirus 1
guccuggagacgggugagugucggcgaggacguuucguugcuuccagcuccggggc

SEQ ID NO: 2439 - RNA, 56 nt, Human herpesvirus 1
aggccgcagacgaggaaaauaaaauuacaucaccuacccacguggugcuguggccu

SEQ ID NO: 2440 - RNA, 78 nt, Human herpesvirus 1
cguggcgcccguggggggugggcacacguaaaaguuugcaucgguguucuccgccuugaugucccgcaggugcucgcg

SEQ ID NO: 2441 - RNA, 60 nt, Human herpesvirus 1
agugagggucgcgucgucuaugcgcuggaggugcgccgagaacagcgucacccgauuacu

SEQ ID NO: 2442 - RNA, 76 nt, Human herpesvirus 1
gcccccgaccgccccguccccccaggugugccaggacggccagggcauacgcggugugaaaaaaggcgucgggggc

SEQ ID NO: 2443 - RNA, 79 nt, Human herpesvirus 1
aaacgcgggcguauuggucccaauggggucucggugggguaucgacagagugccagcccugggaccgaaccccgcguuu

SEQ ID NO: 2444 - RNA, 69 nt, Human herpesvirus 1
cgggcgucaccaugcagcgccggacgcgcggcgcgagcucccugcggcuggcgcggugccugacgccug

SEQ ID NO: 2445 - RNA, 55 nt, Human herpesvirus 1
gcgcgcccgcccccagaaaggugaccacgggcacccagacguuuucgggccgcgc

SEQ ID NO: 2446 - RNA, 56 nt, Human herpesvirus 1
gggccggcuccgcgggccagggcccgggcacgggccucgggccccaggcacggccc

SEQ ID NO: 2447 - RNA, 61 nt, Human herpesvirus 1
gcacgcugggcuucgggaucgaccggauaaaugcccggaacgccuccggggaccggugugc

SEQ ID NO: 2448 - RNA, 56 nt, Human herpesvirus 1
cggcgggcugacgaucggaggcagcgcgcgcuacugguggaucggugggcccgccg

SEQ ID NO: 2449 - RNA, 64 nt, Human herpesvirus 1
caccgucaggugggccaggcgcuuguugguguacgcgcgcgggugucugcucaguucggcggug

SEQ ID NO: 2450 - RNA, 55 nt, Human herpesvirus 1
ccaugggcgguggaggaguuccggggcgcgcgggagcucauccaacgccgcaugg

SEQ ID NO: 2451 - RNA, 64 nt, Human herpesvirus 1
ggacccgccgcuuacgggggcgggggggaagggcuccagguccuugagaagaaaggcggggucu

SEQ ID NO: 2452 - RNA, 56 nt, Human herpesvirus 1
guuagcggggacuccggaugggccgucgggcgcgucucucuggaccugcgaauggc

SEQ ID NO: 2453 - RNA, 59 nt, Human herpesvirus 1
agggggcgugaggaccgggaggcggccagaaccgccgugcacgacccggagcguccccu

SEQ ID NO: 2454 - RNA, 56 nt, Human herpesvirus 1
cgggccguggccgagaucgucuggaccucguuggccaagugcgcguucaugguucg

SEQ ID NO: 2455 - RNA, 65 nt, Human herpesvirus 1
uugggugggguugauacgggaaagacgauaucgggcuuuugaugcgaucguccccgcccgcccag

SEQ ID NO: 2456 - RNA, 60 nt, Human herpesvirus 1
cggccugggugggcggagggaacuaacccaacguauaaauccguccccguuccaaggccg

SEQ ID NO: 2457 - RNA, 55 nt, Human herpesvirus 1
gauccaggaugauguuugugauugccagcgcgccguugaauaucucguugcgauu

SEQ ID NO: 2458 - RNA, 151 nt, Human herpesvirus 1
uguuuugggucaauaaaugcguguuuucauccaacccguguguuuuguguuugugggauggaggggcgggugugauagacccacaggcauccaacauaaacaacuacacacaggaaagaugcgauacaaacguuuuuuauugcccggaacg

SEQ ID NO: 2459 - RNA, 55 nt, Human herpesvirus 1
aggcccuagucagccaacucggcaacgccggggagguguuuaacuuuggggauuu

SEQ ID NO: 2460 - RNA, 113 nt, Human herpesvirus 1
gcgggggggugcuuaagaggaucgcggcgcucuucugcgugcccguggccaccaagaccaaaccccgagccgccuccgaaugagaguguuucguuccuucccccuccccccgc

SEQ ID NO: 2461 - RNA, 58 nt, Human herpesvirus 1
aaggaaagaggaaacaggccgcggacacccgggggaguuuguguucccuuuucuuucu

SEQ ID NO: 2462 - RNA, 105 nt, Human herpesvirus 1
gccccgggacggccgccaggucgccgucgaagcccucggccagcgccuccaggaucccgcggcaggcggccaggcacucgacggccacgcggccggccugggcgc

SEQ ID NO: 2463 - RNA, 57 nt, Human herpesvirus 1
ucgucgucagcaccgucauccacaccuuaucguuuuuguguauuggugcgauggcga

SEQ ID NO: 2464 - RNA, 84 nt, Human herpesvirus 1
gggacccuaggacaaagacccgauaccgggggccgcccgggggcccgggaagagcccccgggggguuuucguccgcgggguccc

SEQ ID NO: 2465 - RNA, 135 nt, Human herpesvirus 1
gaacaccgaggaaaaaaaaaccacagcgcaugcgccgggccguuguggggccccgggccggggccccuuggguccgccggggccccgggccgggccgccacgggggccggccguuggcgguaaccccgaguguuc

SEQ ID NO: 2466 - RNA, 81 nt, Human herpesvirus 1
gaagagggaagaagaggggucgggauccaaaggacggacccagaccaccuuugguugcagaccccuuucuccccccucuuc

SEQ ID NO: 2467 - RNA, 81 nt, Human herpesvirus 1; identical to SEQ ID NO: 2466

SEQ ID NO: 2468 - RNA, 55 nt, Human herpesvirus 1
uguugcgcaauugcauccagguuuucaugcacgggaugcagaagcggugcaugca

SEQ ID NO: 2469 - RNA, 70 nt, Human herpesvirus 1
gcccgggcaaguaugccccccuggcgagcccagaccccuucuccccacaacauggagcauacgcucgggc

SEQ ID NO: 2470 - RNA, 55 nt, Human herpesvirus 1
ccgacgccaacccaggccgcggcggggagccgagcccgcauggggggugucccgg

SEQ ID NO: 2471 - RNA, 55 nt, Human herpesvirus 1
ggcaugccaaacauccggggggacuugagguccggcuccuggaggcaaaacugcc

SEQ ID NO: 2472 - RNA, 65 nt, Human herpesvirus 1
cgaggcgcaccccgaucgcacgcuguucgcgcacgucgcgcugugcgcgaucgggcggcgccucg

SEQ ID NO: 2473 - RNA, 60 nt, Human herpesvirus 1
acgcguccacgaccugguuggccacccggggccuguugagauccccagguagguacgugu

SEQ ID NO: 2474 - RNA, 56 nt, Human herpesvirus 1
cauccggaagcgggggccccgcgccguccgcgcggcgccuccggaaccuccgggug

SEQ ID NO: 2475 - RNA, 75 nt, Human herpesvirus 1
ggguugcgauugguucugggggcacgccggcggggguccgacaaaccaucggcagccccgggaccaccgcgaccc

SEQ ID NO: 2476 - RNA, 56 nt, Human herpesvirus 1
augucgcgaucccccccgcguuccaucguggagugcgguggggugcccgcgaucau

SEQ ID NO: 2477 - RNA, 62 nt, Human herpesvirus 1
ccagcgccauacguacuauagcgaaugcgaugaauuucgauucaucgccccgcgggugcugg

SEQ ID NO: 2478 - RNA, 55 nt, Human herpesvirus 1
ggaggagucgccggauacgugggcguacgcggaucugguccuguugcuccucgcc

SEQ ID NO: 2479 - RNA, 55 nt, Human herpesvirus 1
ggggcggccgucgccaguagcguguucguggcgaccgugaaaagccuggggcccc

SEQ ID NO: 2480 - RNA, 55 nt, Human herpesvirus 1
cgccuucuccgugacauacagggucauggauuggcuauggucgacguagggggcg

SEQ ID NO: 2481 - RNA, 67 nt, Human herpesvirus 1
gcucucggcgggggccgucuggccggccguuaggcugggggcgcagauagccgcccccuccgagagc

SEQ ID NO: 2482 - RNA, 77 nt, Human herpesvirus 1
ggggggcgcgggggccacguacgaccugcaggccaucaaggacaucugcgccaccuacgcgauuccccacgcccccc

SEQ ID NO: 2483 - RNA, 55 nt, Human herpesvirus 1
gaggcggccugggucuuccgcggagcucccgggagcuccgcaccaagccgcucuc

SEQ ID NO: 2484 - RNA, 61 nt, Human herpesvirus 1
cccguugaccagccgcgucacauacucccugagauaauagggcauguaugcguucggcggg

SEQ ID NO: 2485 - RNA, 66 nt, Human herpesvirus 1
cagggcggcguccggguuuuuugcgcccgccggcccucgcggagccagccggggacccccgccuug

SEQ ID NO: 2486 - RNA, 56 nt, Human herpesvirus 1
ccguccccgccccguacgucguccacgguucucuaacgaugcgggggguggcacgg

SEQ ID NO: 2487 - RNA, 56 nt, Human herpesvirus 1
cgccccgcgcccccccacgcagaggcgccgccgcgccccccgugacgggcggggcg

SEQ ID NO: 2488 - RNA, 56 nt, Human herpesvirus 1; identical to SEQ ID NO: 2487

SEQ ID NO: 2489 - RNA, 78 nt, Human herpesvirus 1
gcuagccugauuaaauacgcccccagcucguuaggccacacccuuuuggaagaggcaaugagcggggggaagguuggc

SEQ ID NO: 2490 - RNA, 55 nt, Human herpesvirus 1
gucguccaggucgucgucauccucguccguggugggcuccgggugggugggcgac

SEQ ID NO: 2491 - RNA, 91 nt, Human herpesvirus 1
gauggcccuccaggcugucgacgcccccucccuguuugucgccuggcuggccgcucgguggcuccggggggcuuccggccugggggccguc

SEQ ID NO: 2492 - RNA, 63 nt, Human herpesvirus 1
gauuaggcuacgagucgcggugaucgcuucccaaaaaccgagcugcguuugucugucuugguc

SEQ ID NO: 2493 - RNA, 55 nt, Human herpesvirus 1
guggacagucgauaagucgguagcgggggacgcgcaccuguuccgccugucgcac

SEQ ID NO: 2494 - RNA, 55 nt, Human herpesvirus 1
gugucgcgugucgcgcaugcgcauaaaaaauuugguguggugccgccugugauac

SEQ ID NO: 2495 - RNA, 55 nt, Human herpesvirus 1
ggcgacguugcccgcgugacccugggguuucccaaggagcugcgcgucaagagcc

SEQ ID NO: 2496 - RNA, 65 nt, Human herpesvirus 1
ccagcccuuguuuuacuagauacccccccuuaaugggugcgggggggucaggucugcgggguugg

SEQ ID NO: 2497 - RNA, 55 nt, Human herpesvirus 1
gaugccuuucaaaccgaccagucgaugggugaaaucgaccgggucucgagguauc

SEQ ID NO: 2498 - RNA, 106 nt, Human herpesvirus 1
guaguuggugaucagguacaacaggcgcuccucccgggagagcggcggcccgcggcgcucgaaaaucgcagcgcuggcggccgucucgaggacgcgcuccagcugc

SEQ ID NO: 2499 - RNA, 55 nt, Human herpesvirus 1
ucggugcaggaacacacgggcgaauccguuucgcgagguuccgccguggggccga

SEQ ID NO: 2500 - RNA, 56 nt, Human herpesvirus 1
gggggggagccccccccgcgaggaagaccccggcaguugcgggggcgcccccccuc

SEQ ID NO: 2501 - RNA, 133 nt, Human herpesvirus 1
ggguguuaaguuuccgcgagcgccugcccgcccggacugaccuggccucuggccgccacaaagggcgggggggguuaacuacacuauagggcaacaaaggaugggagggguggcggggcgggacggggcgccc

SEQ ID NO: 2502 - RNA, 132 nt, Human herpesvirus 1
caauaaaaaacguuuguaucgcaucuuuccuguguguaguuguuuauguuggaugccugugggucuaucacacccgccccuccaucccacaaacacaaaacacacggguuggaugaaaacacgcauuuauug

SEQ ID NO: 2503 - RNA, 56 nt, Human herpesvirus 1
cggacggaacaccgcaguuucuggugcucgaaggucgacuccagggacgccgucug

SEQ ID NO: 2504 - RNA, 64 nt, Human herpesvirus 1
gagggggaacucgugggugcugauugacgcgggaaauccccccccauucuuacccgccccccuu

SEQ ID NO: 2505 - RNA, 55 nt, Human herpesvirus 1
cgcccgcacgcgcagcccggauauuagcacacccgggcugguucgcagcgaggug

SEQ ID NO: 2506 - RNA, 56 nt, Human herpesvirus 1
ggccuguacgucccucggcccgacgacccagucuuggccgaugccaucaacgggcu

SEQ ID NO: 2507 - RNA, 103 nt, Human herpesvirus 1
ucggggaaguggcugucgagcacguagcccugcaccaagaucugcuuaaaguucgggugacggggguucgcgaagacgggcucgcggcggaccagauccccgg

SEQ ID NO: 2508 - RNA, 56 nt, Human herpesvirus 1
ggucucuagcguggucgcccugucgccuuacgugaacaagacuaucacgggggacu

SEQ ID NO: 2509 - RNA, 55 nt, Human herpesvirus 1
aucuccgaggaggacgaccuggggccgggguggcccccgguaacgucccggggau

SEQ ID NO: 2510 - RNA, 68 nt, Human herpesvirus 1
cggggggaggagcggggggaggagcggccagacgccgaaaacgggccccccccaaaacacaccccccg

SEQ ID NO: 2511 - RNA, 56 nt, Human herpesvirus 1
agcagguaguaccgaguggugagcaccaggcuuuuuucguccggcccgaauuugcu

SEQ ID NO: 2512 - RNA, 55 nt, Human herpesvirus 1
cgggccgccgcggcgcaggcccgcccgcgccccguggccgugucgcgccggcccg

SEQ ID NO: 2513 - RNA, 98 nt, Human herpesvirus 1
gcggccccgccccccacgcccgccgcgcgcgcgcacgccgcccggaccgccgcccgccuuuuuugcgcgcgcgcgcgcccgcggggggcccgggcugc

SEQ ID NO: 2514 - RNA, 66 nt, Human herpesvirus 1
agccccacgcagggucugcgagcaauaccugcccggggaaagcuacgccuaccucugccugggguu

SEQ ID NO: 2515 - RNA, 56 nt, Human herpesvirus 1
ggcgcugcguccgcgagcagcgcggggagcucgagaagaugcugcgggucagcguc

SEQ ID NO: 2516 - RNA, 56 nt, Human herpesvirus 1
guccugucgggucacgaaugcgacguagugcgcguacgccguguccuucacggggc

SEQ ID NO: 2517 - RNA, 102 nt, Human herpesvirus 1
ccccccacgccaaugacccacguacuccaagaaggcaugugucccaccccgccuguguuuuugugccuggcucucuaugcuugggucuuacugccugggggg

SEQ ID NO: 2518 - RNA, 71 nt, Human herpesvirus 1
ggcccgacagucuggucgcauuugcaccucggcacucggagcgagacgcagcagccaggcagacucgggcc

SEQ ID NO: 2519 - RNA, 71 nt, Human herpesvirus 1; identical to SEQ ID NO: 2518

SEQ ID NO: 2520 - RNA, 70 nt, Human herpesvirus 1
aaaauaaccaaaaacaccacaggggaccgcguguucuuuuuaucgcacgugauuguguguuuauuauuuu

SEQ ID NO: 2521 - RNA, 67 nt, Human herpesvirus 1
ccggccucuggcgucggcgcgugugggucuaccgcugagggaccaccggcgucggcgcccgggccgg

SEQ ID NO: 2522 - RNA, 56 nt, Human herpesvirus 1
gcugggccugaagcagguaguaccgaguggugagcaccaggcuuuuuucguccggc

SEQ ID NO: 2523 - RNA, 56 nt, Human herpesvirus 1
agcagugcuuugccgccaaaugcgacagcaaccgccugcacacgcuguuuaccauu

SEQ ID NO: 2524 - RNA, 56 nt, Human herpesvirus 1
ggcggucgggcgauugauauauuuuucaauaaaaggcauuagucccgaagaccgcc

SEQ ID NO: 2525 - RNA, 56 nt, Human herpesvirus 1
ccgggucggcgaggacguuggggugaaugcccucgagggcggggaagcggaucugg

SEQ ID NO: 2526 - RNA, 85 nt, Human herpesvirus 1
ggccgaggcggucaucgggccgugccuggggcccgaggcccgugcccgggcccuggcccgcggagccggcccggcgaacucgguc

SEQ ID NO: 2527 - RNA, 55 nt, Human herpesvirus 1
cgcggcggugguaaugacaagcgcccagauaacaaugggcaugccuuaugccgug

SEQ ID NO: 2528 - RNA, 94 nt, Human herpesvirus 1
cuggggcgugcguuaagggguccguuguguuggccgcagguccccgauggguggcggcaagaacagcccccacgaggcuucccaaaagccccag

SEQ ID NO: 2529 - RNA, 57 nt, Human herpesvirus 1
gucgagcguaccgacgggcggcacaccuaucacgugacuggccgucaggagcucggc

SEQ ID NO: 2530 - RNA, 66 nt, Human herpesvirus 1
gggggugguacuggugccggucgugagagaaucccccguguucccacgcuucccgccaacaccccc

SEQ ID NO: 2531 - RNA, 87 nt, Human herpesvirus 1
ugugacguucuucucgccguccagguggcgaaucaggcgcuugaaaaacaggucuggcauccagagggcgcugaagauauugucgca

SEQ ID NO: 2532 - RNA, 70 nt, Human herpesvirus 1
cucggggucagccucgagcuggucgacgacggguacgauacagucgaagaggcucguguuguuuuccgag

SEQ ID NO: 2533 - RNA, 56 nt, Human herpesvirus 1
gggggaguuugagacggccgagcgccgcuuuaguuccggucaacccagccuucucc

SEQ ID NO: 2534 - RNA, 60 nt, Human herpesvirus 1
gcgggccugucguguagauucgaaaccacggacgggugauugugucgcagggcggcccgc

SEQ ID NO: 2535 - RNA, 90 nt, Human herpesvirus 1
aggguccuugccgccccccgccucaccgucguccaggucgucgucauccucguccguggugggcuccgggugggugggcgacagggcccu

SEQ ID NO: 2536 - RNA, 73 nt, Human herpesvirus 1
gcuuccguaccgacggcggggugcccgggcggcaugcccagaagcaacccaagcccucgcccuccccgggagc

SEQ ID NO: 2537 - RNA, 59 nt, Human herpesvirus 1
cccgcgcucgcgaguacuuccacgcccugguguauuuuguaugucgcaacgccgcaggg

SEQ ID NO: 2538 - RNA, 120 nt, Human herpesvirus 1
cuucuggucguagucaaacgcggucuugaaucgccggagggggugggugggcuccaggcacgggagcgccugcgccacggaccacugcuuggcgucgagacuguccaucaccuccaggag

SEQ ID NO: 2539 - RNA, 55 nt, Human herpesvirus 1
ggggcgcuccugauguggcugcuccgcuaaaagaccgcaucgacacgcgcguccu

SEQ ID NO: 2540 - RNA, 57 nt, Human herpesvirus 1
ccccugguccuggcccgcagacccgcggcuguuuccgcccuugccgaauccagggag

SEQ ID NO: 2541 - RNA, 141 nt, Human herpesvirus 1
gccuuucugccucugccgcuugugagugcgcgcgccggcucugcggugucggcggcggcugcggcggcugcggcggccgccguguucggucucgguagccggccggcggguggacucgcggggggccggaggguggaaggc

SEQ ID NO: 2542 - RNA, 141 nt, Human herpesvirus 1; identical to SEQ ID NO: 2541

SEQ ID NO: 2543 - RNA, 56 nt, Human herpesvirus 1
ugucgcauggggaaagugcccacgaggcccgcgagggcacgaggaccaacgcggca

SEQ ID NO: 2544 - RNA, 60 nt, Human herpesvirus 1
gggccgaacaggcgcugggaaccaacgccaaggcggugacccuugcccuggagacggccc

SEQ ID NO: 2545 - RNA, 96 nt, Human herpesvirus 1
ggauccaaagguugugagcuggcggcgagauugaugcccaucgcuacggggguauacagacggagccguuggugauaagaucucaaagccggaucc

SEQ ID NO: 2546 - RNA, 56 nt, Human herpesvirus 1
aggaggaacguccucgucgaggcgaccggcggcgaccguugcguggaccgcuuccu

SEQ ID NO: 2547 - RNA, 56 nt, Human herpesvirus 1; identical to SEQ ID NO: 2546

SEQ ID NO: 2548 - RNA, 55 nt, Human herpesvirus 1
ggacucaaccgccgaacccaggaacccgccgcuccugguguuuacgaacgaguuu

SEQ ID NO: 2549 - RNA, 55 nt, Human herpesvirus 1
ggggggacgcguggacuggggggagggguuuuccuggcccgacccgcgccucuuc

SEQ ID NO: 2550 - RNA, 55 nt, Human herpesvirus 1
cgcacgacguguuucaggccaccacgcccggccuguacgccaucagcgaauugcg

SEQ ID NO: 2551 - RNA, 79 nt, Human herpesvirus 1
gggcgcacgugucggggaggcgcgcgaccgggcugggaggcccgccacgcccauaagcuccucccgauaaaaagcgccc

SEQ ID NO: 2552 - RNA, 66 nt, Human herpesvirus 1
ggggggaggagcggggggaggagcggccagacgccgaaaacgggccccccccaaaacacacccccc

SEQ ID NO: 2553 - RNA, 58 nt, Human herpesvirus 1
cgcgccagucguucuagguucaccaugcaggcgugguacgugcgggccaaggcgcggg

SEQ ID NO: 2554 - RNA, 69 nt, Human herpesvirus 1
ggucuuauuugguauuaccugguuuauuuaaaaagauauacaguaagacaucccaugguaccaaagacc

SEQ ID NO: 2555 - RNA, 79 nt, Human herpesvirus 1
ggggugccgcuguggccucaccugaccaaccuuuacacgggggcccggaacgggaggccacagcgccgucuuucucccc

SEQ ID NO: 2556 - RNA, 56 nt, Human herpesvirus 1
gcggggcucuggcugcgguucagcuccuguuucccgcggcccgcguggaccccgac

SEQ ID NO: 2557 - RNA, 56 nt, Human herpesvirus 1
ccucgucgaccagaucucgauccaccagaggaaggucaucccgcauggucaugggg

SEQ ID NO: 2558 - RNA, 56 nt, Human herpesvirus 1
cgccuuccgggggggcccccaaaccccguaugguuuuggauuccccugacggggcg

SEQ ID NO: 2559 - RNA, 56 nt, Human herpesvirus 1
cgguugcccgcagcagagucugguccucccacaggaauagguuguggccccggcug

SEQ ID NO: 2560 - RNA, 103 nt, Human herpesvirus 1
ucgacgcggccacggcgacucgagggcguucugcggcgucgcgccccaccgagcgaccucgagccccagcccgcuccgcuucucgccccagacggcccgucga

SEQ ID NO: 2561 - RNA, 57 nt, Human herpesvirus 1
cccaugcggcguuggaugagcucccgcgcgccccggaacuccuccaccgcccauggg

SEQ ID NO: 2562 - RNA, 73 nt, Human herpesvirus 1
gacccacguacuccaagaaggcaugugucccaccccgccuguguuuuugugccuggcucucuaugcuuggguc

SEQ ID NO: 2563 - RNA, 55 nt, Human herpesvirus 1
gccgcgcgcugcuggcgcuccagggcccccgcuguugcgcgccggagcucgcggu

SEQ ID NO: 2564 - RNA, 55 nt, Human herpesvirus 1
ccggggcugcccggccgugaagcggcccguggcgucgcggccggccaccgccgcg

SEQ ID NO: 2565 - RNA, 55 nt, Human herpesvirus 1; identical to SEQ ID NO: 2564

SEQ ID NO: 2566 - RNA, 57 nt, Human herpesvirus 1
ccccgccgcuugaucauuaucaccccguugcggggguccggagaucaugcgcgggug

SEQ ID NO: 2567 - RNA, 61 nt, Human herpesvirus 1
ggcccccaucaccgccccuaaccgcagggcgccguggguugggggcgcguggggaggggcc

SEQ ID NO: 2568 - RNA, 55 nt, Human herpesvirus 1
ggccggccggcgcuuagggggaggaugucgccgacgccccuuggccgccccggcu

SEQ ID NO: 2569 - RNA, 80 nt, Human herpesvirus 1
gccacgcgcguggagucgaaggccagcgccagcucaaaaaacccggggccggcgcgcuccgcggccuccgcgaccguggc

SEQ ID NO: 2570 - RNA, 73 nt, Human herpesvirus 1
gggcgccgucccaaccgcacagucccagguaaccuccacgcccaacucggaacccgcggucaggagcgcgccc

SEQ ID NO: 2571 - RNA, 117 nt, Human herpesvirus 1
ccaccucgaucuccagguaguccuugcccgccuccaggugcgccacugcgucggcccucagggagagcgugcugaagcacagguugugggccuggaugaugcugggguacaggcugg

SEQ ID NO: 2572 - RNA, 55 nt, Human herpesvirus 1
ucggacggcaggcacacguaacgcacgcuagggugugugcgucgcccgcgucugg

SEQ ID NO: 2573 - RNA, 100 nt, Human herpesvirus 1
cccccaggcaguaagacccaagcauagagagccaggcacaaaaacacaggcggggugggacacaugccuucuuggaguacgugggucauuggcguggggg

SEQ ID NO: 2574 - RNA, 100 nt, Human herpesvirus 1; identical to SEQ ID NO: 2573

SEQ ID NO: 2575 - RNA, 60 nt, Human herpesvirus 1
agcggggcccacgcggucaauguguuugacuugcacgaacucgcugacgguggcccgcuu

SEQ ID NO: 2576 - RNA, 55 nt, Human herpesvirus 1
gguuuugagcagcugggcaaagucccgcacaaagugcaccagcuggcgaaaggcu

SEQ ID NO: 2577 - RNA, 73 nt, Human herpesvirus 1
cgugucgauggccgucuuugacgagccgcccaccgacaucuccgcguggccgcuguucgagggccaggacacg

SEQ ID NO: 2578 - RNA, 56 nt, Human herpesvirus 1
acgguggacagcaucgggaugcugccccgcuucauccccgagaaccagcgcaccgu

SEQ ID NO: 2579 - RNA, 65 nt, Human herpesvirus 1
cccccagagacuuguuguaggagcauucgguguacuccaugaccgugauggggauagcacaguug

SEQ ID NO: 2580 - RNA, 55 nt, Human herpesvirus 1
gcguuugagcgcggcacggccgaccagaugcugcacgugcugcuggaaaaggcgc

SEQ ID NO: 2581 - RNA, 56 nt, Human herpesvirus 1
ucuggggcgaacuguuuggcgugcagauggccaaaagcacgcagacguuucccggg

SEQ ID NO: 2582 - RNA, 55 nt, Human herpesvirus 1
agcugggggcguauuuaaucaggcuagcgcggcgggccugccguaguuucuggcu

SEQ ID NO: 2583 - RNA, 86 nt, Human herpesvirus 1
ccaggcggacuuccguggcuuuuuguugccggcgagggcgcaacgccguacgucgguuguuauggccgcgagaacgcgcagccugg

SEQ ID NO: 2584 - RNA, 81 nt, Human herpesvirus 1
ucgcuggguucguggaagauaaagcgccgcgugucggcgccggccucgccgccgucguccgcgcggcccacgcaguagcga

SEQ ID NO: 2585 - RNA, 56 nt, Human herpesvirus 1
ggguccgucacggggucgcuggggcacuccucgccgggggcgaucuccgggaccac

SEQ ID NO: 2586 - RNA, 76 nt, Human herpesvirus 1
uccucgugcccgggacccacguggcggccaacccacagguggaccgcgagggacacguggugcccggguucgaggg

SEQ ID NO: 2587 - RNA, 117 nt, Human herpesvirus 1
ggggccugcgcgggcgccuccgccacccgcuggguccggaggggccggacgcacacccaccaccgccccccgggccccccgaacccagcggguggcgacuaaggcccccgcggcccc

SEQ ID NO: 2588 - RNA, 56 nt, Human herpesvirus 1
ccuccuugaagcccucgguaacgaccagauacaggagggcgcgguccggguccagg

SEQ ID NO: 2589 - RNA, 78 nt, Human herpesvirus 1
ucaucguccaggcgaccgcgcaccgacuggcuacgggccgcaucgggcccggggcgcugccgggacgcucggcgaugg

SEQ ID NO: 2590 - RNA, 56 nt, Human herpesvirus 1
gguggguccguggggguguccagaucaauaacgacaaacggccccucguuccuacc

SEQ ID NO: 2591 - RNA, 55 nt, Human herpesvirus 1
gugguguucgggaccugguaccgcacuauccaggaccgcaccaucacggacuuuc

SEQ ID NO: 2592 - RNA, 57 nt, Human herpesvirus 1
gaguuagacaggcaagcacuacucgccucugcacgcacaugcuugccugucaaacuc

SEQ ID NO: 2593 - RNA, 57 nt, Human herpesvirus 1; identical to SEQ ID NO: 2592

SEQ ID NO: 2594 - RNA, 65 nt, Human herpesvirus 1
gcgguacucuggguucccuagguucucgggguggucgcggaacccggggcucccggggaacacgc

SEQ ID NO: 2595 - RNA, 81 nt, Human herpesvirus 1
cgcgcaccgccucgcgccccagcgccacguacacgggccgcagcggcgcgcccaggccccagcgcgcgcaggcggcgugcg

SEQ ID NO: 2596 - RNA, 58 nt, Human herpesvirus 1
ggaggaggccgucccgccggagacaaagccgucccggguguuuccucauggccccuuu

SEQ ID NO: 2597 - RNA, 123 nt, Human herpesvirus 1
ugcgcaucagcucgcggcccggggccugcuacagccgcccccuggucagcuuucgguacgaagaccagggcccguuggucgaggggcagcugggggagaacaacgagcugcggcugacgcgcg

SEQ ID NO: 2598 - RNA, 74 nt, Human herpesvirus 1
cggccacguccguccgcacgcgcgccauuagcguccccgggggcgcacaggccgagcgcgggcugacgcggcug

SEQ ID NO: 2599 - RNA, 56 nt, Human herpesvirus 1
cgacgaccacagagaaggugcgauggguauuuuccccguacaccgucuuggcguug

SEQ ID NO: 2600 - RNA, 56 nt, Human herpesvirus 1
aggccacagcaccacguggguaggugauguaauuuuauuuuccucgucugcggccu

SEQ ID NO: 2601 - RNA, 74 nt, Human herpesvirus 1
ccucgaacccgggcaccacgugucccucgcgguccaccuguggguuggccgccacgugggucccgggcacgagg

SEQ ID NO: 2602 - RNA, 83 nt, Human herpesvirus 1
gggggaaccccacgucgcucggcggggacgucuaccgguacccagacggccgacguccccaccgaggcccuugggggcccccc

SEQ ID NO: 2603 - RNA, 55 nt, Human herpesvirus 1
ucgggaaaagauucagcgggcgcggcgcgacaacgagcccccgccccucccccga

SEQ ID NO: 2604 - RNA, 72 nt, Human herpesvirus 1
gggggacgugggguuggugugcaaaggcacgcgcacccgcgcggccaggugggccgguacuccauccccccc

SEQ ID NO: 2605 - RNA, 56 nt, Human herpesvirus 1
cggggacccgggggacggccggguccggagccgcgcugccguccgccgcgcccucg

SEQ ID NO: 2606 - RNA, 56 nt, Human herpesvirus 1
cccggagaggcguccauugacacacaaggguguaguagcgauauacguuuauuggg

SEQ ID NO: 2607 - RNA, 56 nt, Human herpesvirus 1
ggggcauccuccgugucggacugggacgcgagcgugugguccgaaccggcggccuc

SEQ ID NO: 2608 - RNA, 146 nt, Human herpesvirus 1
gcccccggggcccgagcccgcccccgcccagcccgcggcgccccgggccgccgcggcgcaggcccgcccgcgccccguggccgugucgcgccggcccgccgagggccccgacccccugggcggcuggcggcggcagcccccggggc

SEQ ID NO: 2609 - RNA, 62 nt, Human herpesvirus 1
ccggacccccaggcucgcccgggccggcaugugcaagggccuuguuugucuggcggauccgg

SEQ ID NO: 2610 - RNA, 56 nt, Human herpesvirus 1
gugguccccggggacguggcgcuggaccaggccugcuuccggaucucgggcgccgc

SEQ ID NO: 2611 - RNA, 73 nt, Human herpesvirus 1
aaccuccgggggcggcgugugggggugccccaaggagggcgccucggucaccccaaucccccccgaccggguu

SEQ ID NO: 2612 - RNA, 64 nt, Human herpesvirus 1
cgugacguuugauacccuguuuauggugucgucgaucgacgaauuagggcgucgccagcucacg

SEQ ID NO: 2613 - RNA, 55 nt, Human herpesvirus 1
ggucccggcgcuggcgguaagugaauaccagguacagaaacgccgcgcccgggcc

SEQ ID NO: 2614 - RNA, 55 nt, Human herpesvirus 1
ccaugcggcguuggaugagcucccgcgcgccccggaacuccuccaccgcccaugg

SEQ ID NO: 2615 - RNA, 73 nt, Human herpesvirus 1
gccgccucccccgagucuucggaaugucuuggcggccgucaagaacuguuaucccgaggcacggaugagcggc

SEQ ID NO: 2616 - RNA, 55 nt, Human herpesvirus 1
ggccgcgcccagggccgucaccgcgucgaccaggacgcggugcgcccgcacggcc

SEQ ID NO: 2617 - RNA, 56 nt, Human herpesvirus 1
gucugcgugucgaucuggcccggguuaaacaccugguggucguccucgaaccagac

SEQ ID NO: 2618 - RNA, 56 nt, Human herpesvirus 1
cgggccccggccuccaggcccgccccgcccugcgcggaccacgcggccgcagccug

SEQ ID NO: 2619 - RNA, 121 nt, Human herpesvirus 1
ggucgccagggccgugugcagcgcguacaccgcagcgcccagcacggcguugagcccgcuguuggcgagcagccggcgcgcugcggugucgcccagcgccucgugcucggcccccacgacc

SEQ ID NO: 2620 - RNA, 102 nt, Human herpesvirus 1
ccgcccccggcuacaggggccauguugggccgccacgcgcggcugguccacacccaguggcuccgggccaaccaagagacgucgccccuguggcccuggcgg

SEQ ID NO: 2621 - RNA, 61 nt, Human herpesvirus 1
ggucgcccacggcccgagccucuaucgcacuuuugccggcaauccucgggccgcaucgacc

SEQ ID NO: 2622 - RNA, 55 nt, Human herpesvirus 1
ggggccccaggcuuuucacggucgccacgaacacgcuacuggcgacggccgcccc

SEQ ID NO: 2623 - RNA, 55 nt, Human herpesvirus 1
cgccacccaccgcacccccgcggcgcgcguuacggccauggaccuggugcuggcg

SEQ ID NO: 2624 - RNA, 55 nt, Human herpesvirus 1
gugucccuuuccgaugcgaucccgaucccgagccggggcgucgcgaugccgacgc

SEQ ID NO: 2625 - RNA, 55 nt, Human herpesvirus 1; identical to SEQ ID NO: 2624

SEQ ID NO: 2626 - RNA, 55 nt, Human herpesvirus 1
cuccccucugcucuuuccccgugacacccgacgcugggggcguggcugccgggag

SEQ ID NO: 2627 - RNA, 55 nt, Human herpesvirus 1
ggguccuugaccccacuuccggguuucacgugaaccccguggugguguucgacuu

SEQ ID NO: 2628 - RNA, 56 nt, Human herpesvirus 1
gauucgugcgccacgucggccagcgucaguugccggcggauggucggcaggaauac

SEQ ID NO: 2629 - RNA, 55 nt, Human herpesvirus 1
ugggggggcggcaaggcgggcggcccuugggccgcccgccgucccguuggucccg

SEQ ID NO: 2630 - RNA, 55 nt, Human herpesvirus 1; identical to SEQ ID NO: 2629

SEQ ID NO: 2631 - RNA, 57 nt, Human herpesvirus 1
ccccugggccagacgaccgcgguuccggacuccguggaucugucucgccaggggcug

SEQ ID NO: 2632 - RNA, 64 nt, Human herpesvirus 1
gggcggugguggacaggucguagagcagacaggauaucuggaugaccagguccuccgggugccc

SEQ ID NO: 2633 - RNA, 55 nt, Human herpesvirus 1
ggcgggagccgccgccgccgcugcuguugguggugguguugguguuacugcugcc

SEQ ID NO: 2634 - RNA, 55 nt, Human herpesvirus 1; identical to SEQ ID NO: 2633

SEQ ID NO: 2635 - RNA, 102 nt, Human herpesvirus 1
cuccugucccccaaccggggcccgcgcuucgacgggagaggaugcggcugggcggcuggccauuucaacagacgcggcggguuucggcgggcucgagagggg

SEQ ID NO: 2636 - RNA, 56 nt, Human herpesvirus 1
agcgugagcauggcgggcccguccacuaccacgcgcccguugugaaacauggcguu

SEQ ID NO: 2637 - RNA, 71 nt, Human herpesvirus 1
ggagggaggccagccgcugcguccgcgacagguaguucagcuuggcguccguagucgggaagacaaccucc

SEQ ID NO: 2638 - RNA, 55 nt, Human herpesvirus 1
gcgucgauguguagcgcgagggaggaugcccacgaagacaccccagacaaggagc

SEQ ID NO: 2639 - RNA, 83 nt, Human herpesvirus 1
ggggggcccccaagggccucgguggggacgucggccgucuggguaccgguagacguccccgccgagcgacgugggguuccccc

SEQ ID NO: 2640 - RNA, 55 nt, Human herpesvirus 1
ucagggcggcggucagcgacguccugggccaccugacgcgccuagccaaccugug

SEQ ID NO: 2641 - RNA, 138 nt, Human herpesvirus 1
ugucggcucgcgaacccgcggggcgcaggaggcgcgcauccacccgcccccgcgccucgcccguggcggacgagccagcgggcgauggggugggguucaugggguaccugcgugcgguguuccgcggggaugacgaca

SEQ ID NO: 2642 - RNA, 55 nt, Human herpesvirus 1
ucgggggaggggcgggggcucguugucgcgccgcgcccgcugaaucuuuucccga

SEQ ID NO: 2643 - RNA, 79 nt, Human herpesvirus 1
ugggugggcgagguggccgggggaaggcgcccgcuagcgagaccggccguucccggacgacaccuugcgacaaaaccua

SEQ ID NO: 2644 - RNA, 118 nt, Human herpesvirus 1
gccaggggcggcgccuuuuccagcagcacgugcagcaucuggucggccgugccgcgcucaaacgccccgaggacggccuggacguugcgagcgagcuguuggauggcgcgcaacuggc

SEQ ID NO: 2645 - RNA, 56 nt, Human herpesvirus 1
gccccggagcgaguacccgccggccugagggccgcccccagcgcgaggugaggggc

SEQ ID NO: 2646 - RNA, 56 nt, Human herpesvirus 1; identical to SEQ ID NO: 2645

SEQ ID NO: 2647 - RNA, 57 nt, Human herpesvirus 1
gaguuugacaggcaagcaugugcgugcagaggcgaguagugcuugccugucuaacuc

SEQ ID NO: 2648 - RNA, 82 nt, Human herpesvirus 1
cgcggugccuaguggagcucugggguccgagcggcggccccggggccgccgcgucacccccccauuccagcugggcccagcg

SEQ ID NO: 2649 - RNA, 55 nt, Human herpesvirus 1
ccugcuaggcuuuuuggcccacucgcgcgcgcuugccggguuggccgcccgcggg

SEQ ID NO: 2650 - RNA, 67 nt, Human herpesvirus 1
cgagguacggggcggcccgugcggguugcuuaaaugcgugguggcgaccacgggcugucauuccucg

SEQ ID NO: 2651 - RNA, 56 nt, Human herpesvirus 1
ggcgguacugauccgcgccuguuaccgccuacaacagcaguuacagcggacccgcc

SEQ ID NO: 2652 - RNA, 74 nt, Human herpesvirus 1
ggaccuagcgcgcgggagucguggcuuuggggcgcauccauggcuucggaggcggcgcaacccgacgcggguuu

SEQ ID NO: 2653 - RNA, 68 nt, Human herpesvirus 1
ggucuucaucgccgacagcagcaucaccucggcgauguguuuguucagguccugaaauucggcagacu

SEQ ID NO: 2654 - RNA, 67 nt, Human herpesvirus 1
gucauucccgcccggucucgucguuggucuacgcugucccccacccacgcgagccgggcgucauggc

SEQ ID NO: 2655 - RNA, 58 nt, Human herpesvirus 1
ugagguccaaaaucaccucccaguaguacgucagaucucgucgcugcagguccuccag

SEQ ID NO: 2656 - RNA, 55 nt, Human herpesvirus 1
cggcguggggcagguaccgccgcagcucguuggcguccagccgcaccugcgccug

SEQ ID NO: 2657 - RNA, 59 nt, Human herpesvirus 1
cgccguuccguuuuccggaauacguacggacgucaguguugggggagacgguuucggug

SEQ ID NO: 2658 - RNA, 55 nt, Human herpesvirus 1
uguccuuuugucaaucgguccgcgaacggagguaaucccggcacgacgacggacg

SEQ ID NO: 2659 - RNA, 134 nt, Human herpesvirus 1
ugggguugacgcuggggguccugguggcgucggcggcuccgaguucccccggcacgccuggggucgcggccgcgacccaggcggcgaacgggggcccugccacuccggcgccgcccgccccuggcgccccccca

SEQ ID NO: 2660 - RNA, 55 nt, Human herpesvirus 1
aguuagacaggcaagcacuacucgccucugcacgcacaugcuugccugucaaacu

SEQ ID NO: 2661 - RNA, 76 nt, Human herpesvirus 1
cugcacccgcgagccguaccgggccaaugggucgcggcggucgcaccacacgggcccgggggguuuaguggggcgg

SEQ ID NO: 2662 - RNA, 102 nt, Human herpesvirus 1
cccgagccgaugacuuacuggcggguguugggggcuuccgagacaaucgcgaacaucuacaccacacaacaccgccucgaccagggugagauaucggccggg

SEQ ID NO: 2663 - RNA, 59 nt, Human herpesvirus 1
uagcauaucacauaccccguuccgcuuccgcggggacccgggcggggguggauacgcug

SEQ ID NO: 2664 - RNA, 62 nt, Human herpesvirus 1
guugacgaacaugaagggcuggaacagacccgccaacugacgccagcucuccaggucgcaac

SEQ ID NO: 2665 - RNA, 55 nt, Human herpesvirus 1
ucgaagcccucggccagcgccuccaggaucccgcggcaggcggccaggcacucga

SEQ ID NO: 2666 - RNA, 56 nt, Human herpesvirus 1
gucgaggugugcgaggugggccugcggccacgcgggcacccgcaacgagucacggc

SEQ ID NO: 2667 - RNA, 56 nt, Human herpesvirus 1
gcuuaggagcugccgggagaccgcugcgaucugcgggcgucccaguggguucaggc

SEQ ID NO: 2668 - RNA, 74 nt, Human herpesvirus 1
gcggagcgggcuggggcucgaggucgcucgguggggcgcgacgccgcagaacgcccucgagucgccguggccgc

SEQ ID NO: 2669 - RNA, 56 nt, Human herpesvirus 1
cgccagcacggugccgcugcggcccguggccgaggcccagcgaaucccgggcggcg

SEQ ID NO: 2670 - RNA, 56 nt, Human herpesvirus 1; identical to SEQ ID NO: 2669

SEQ ID NO: 2671 - RNA, 56 nt, Human herpesvirus 1
gugcaacgcacgucgggguugccuguguccgguucggcccccaccgcgugcggcac

SEQ ID NO: 2672 - RNA, 56 nt, Human herpesvirus 1
gccgaacagcgcggugggggguuuguucuggaacaccccgcguagcugcggacggc

SEQ ID NO: 2673 - RNA, 56 nt, Human herpesvirus 1
cauaaaccauuccccaugggggaccccgucccuaacccacggggcccguggcuaug

SEQ ID NO: 2674 - RNA, 55 nt, Human herpesvirus 1
gacgaaaaaagccuggugcucaccacucgguacuaccugcuucaggcccagcguc

SEQ ID NO: 2675 - RNA, 56 nt, Human herpesvirus 1
cggaaaccaggcccccucugccgccggccgccggcggcaccgagacgcgcgucucg

SEQ ID NO: 2676 - RNA, 72 nt, Human herpesvirus 1
guccaauugcccgcccaggcggccguguccggcccgcacagccgguuggccagggccgccagcaggcaggac

SEQ ID NO: 2677 - RNA, 72 nt, Human herpesvirus 1; identical to SEQ ID NO: 2676

SEQ ID NO: 2678 - RNA, 56 nt, Human herpesvirus 1
gaccacagucacgcaccuggccgucggggcgcucgcguuggggaaggugacggguc

SEQ ID NO: 2679 - RNA, 56 nt, Human herpesvirus 1
ucguacacgcuccuaaccauuggcccccuagggauggggcuguucagggacggcga

SEQ ID NO: 2680 - RNA, 55 nt, Human herpesvirus 1
gcggacucggucggcaccuauggcgccugacgcgccgcgggcccccggccgccgc

SEQ ID NO: 2681 - RNA, 55 nt, Human herpesvirus 1
gcugauggcguacaggccgggcgugguggccugaaacacgucgugcgccuccagc

SEQ ID NO: 2682 - RNA, 71 nt, Human herpesvirus 1
ggucauccacgccgacgccaacgccgccauguuugcgggccugggcgcguucuucgaggggaugggcgacc

SEQ ID NO: 2683 - RNA, 55 nt, Human herpesvirus 1
accaaucgcccgccggcugccgggacgcccugcugcaacuuaccuccgggauggu

SEQ ID NO: 2684 - RNA, 107 nt, Human herpesvirus 1
agcgauggucagguuguaggguuguuuccggacgucuucggaggccccgcggacaaucuggggggccuccgacggugcguuuaggagcacgcugcggcaggcgcgcu

SEQ ID NO: 2685 - RNA, 56 nt, Human herpesvirus 1
gccacggcggccgccgcgugcgccaggccccagccgaagcggccggccgccauggc

SEQ ID NO: 2686 - RNA, 56 nt, Human herpesvirus 1; identical to SEQ ID NO: 2685

SEQ ID NO: 2687 - RNA, 55 nt, Human herpesvirus 1
agugcucgcacuucgcccuaauaauauauauauauugggacgaagugcgaacgcu

SEQ ID NO: 2688 - RNA, 55 nt, Human herpesvirus 1; identical to SEQ ID NO: 2687

SEQ ID NO: 2689 - RNA, 61 nt, Human herpesvirus 1
uccucgagacggccgccagcgcugcgauuuucgagcgccgcgggccgccgcucucccggga

SEQ ID NO: 2690 - RNA, 92 nt, Human herpesvirus 1
gccccgccccccacgcccgccgcgcgcgcgcacgccgcccggaccgccgcccgccuuuuuugcgcgcgcgcgcgcccgcggggggcccgggc

SEQ ID NO: 2691 - RNA, 57 nt, Human herpesvirus 1
guggcggcccggcccggggccccggcggacccaaggggccccggcccggggccccac

SEQ ID NO: 2692 - RNA, 56 nt, Human herpesvirus 1
cccgccguggcccgggacgacgcggaggggcuuucggacccccggccacgucuggg

SEQ ID NO: 2693 - RNA, 94 nt, Human herpesvirus 1
gcggcggggguccuggucguaacggcaaucguguacgucguccgcacaucacagucgcggcagcgucaucggcgguaacgcaagacccccccgu

SEQ ID NO: 2694 - RNA, 65 nt, Human herpesvirus 1
gggccguccgccuccugcacgccgaccugaacccgaucgaaaacgcgugucuggcggcacagcuc

SEQ ID NO: 2695 - RNA, 57 nt, Human herpesvirus 1
cucgcgccgugcugacaaacgccuugcuguugggcgucuuccugugcacggccgacg

SEQ ID NO: 2696 - RNA, 116 nt, Human herpesvirus 1
ggcgccuggaucugguucgccaacacgaguacaugcaucucacccucccccgugcguuucagaacgcagcagauuccaugcuauucgugcagcgccugaccccgcauccagacgcc

SEQ ID NO: 2697 - RNA, 59 nt, Human herpesvirus 1
cccccgagucggacccggaggccccacgggcgauggccuccgaagggacggcuccgggg

SEQ ID NO: 2698 - RNA, 56 nt, Human herpesvirus 1
agcgcgcgcgagugggccaaaaagccuagcaggucggagaggcagaccgcgccguu

SEQ ID NO: 2699 - RNA, 56 nt, Human herpesvirus 1
ggggcgcguuaaaaaccucaccaaacagacaaucgugggguuguuggacgcccacc

SEQ ID NO: 2700 - RNA, 56 nt, Human herpesvirus 1
uccgccgucgcagccguauccccggaggaucgccccgcaucggcgauggcgucgga

SEQ ID NO: 2701 - RNA, 129 nt, Human herpesvirus 1
cgaucgagccgugcaccgugggacaccggcgcuacuucaccuucggugggggcuacguguacuucgaggaguacgcguacucccaccagcugagccgcgccgacaucaccaccgucagcaccuucaucg

SEQ ID NO: 2702 - RNA, 80 nt, Human herpesvirus 1
gcugccgcucgaucguuguuuucgggugaacccggggcacccauucggccaaaucccccccguacaacauccgcgcuagc

SEQ ID NO: 2703 - RNA, 55 nt, Human herpesvirus 1
uccgcgcccaccuuaaguugccucuguuucucgaggcgcuccagguacugcugga

SEQ ID NO: 2704 - RNA, 62 nt, Human herpesvirus 1
gccucuggcgacagcccgccgucgucgggguagggcgacgcgccgggcgcaggaacaaaggc

SEQ ID NO: 2705 - RNA, 56 nt, Human herpesvirus 1
gcaccugggggugugcgacgagcuggcggcccaggugucgcacgaggacaacgugc

SEQ ID NO: 2706 - RNA, 56 nt, Human herpesvirus 1
gucgccaucgcaccaauacacaaaaacgauaagguguggaugacggugcugacgac

SEQ ID NO: 2707 - RNA, 64 nt, Human herpesvirus 1
gcgacacucacagaucguugacgaccgccccggcguaggaggugcugcgacacucgaaaaaauu

SEQ ID NO: 2708 - RNA, 60 nt, Human herpesvirus 1
ugggcccgacagaccuccccgcgcaugcucuggggucccugucgccucccaacccccuaa

SEQ ID NO: 2709 - RNA, 55 nt, Human herpesvirus 1
cgcgccagcguccggcagcugcaccgccaggcgcacaugcgcggacgcgaucgcg

SEQ ID NO: 2710 - RNA, 56 nt, Human herpesvirus 1
agcuccaggccccgggcgucccggaacgccgccggacauagcgccaggggcaaguu

SEQ ID NO: 2711 - RNA, 113 nt, Human herpesvirus 1
cgcucccgcggccccgccccccacgcccgccgcgcgcgcgcacgccgcccggaccgccgcccgccuuuuuugcgcgcgcgcgcgcccgcggggggcccgggcugccacaggug

SEQ ID NO: 2712 - RNA, 55 nt, Human herpesvirus 1
cccuccccacgcgcccccaacccacggcgcccugcgguuaggggcggugaugggg

SEQ ID NO: 2713 - RNA, 56 nt, Human herpesvirus 1
uggcccgggccgaccaccagaaaacccucuuuuggcuuccggaccacuuuucgcca

SEQ ID NO: 2714 - RNA, 56 nt, Human herpesvirus 1
gcagcgggagggcguacuuacaggagcccuuggcucggugcuccaggauaaacugu

SEQ ID NO: 2715 - RNA, 55 nt, Human herpesvirus 1
cccccgggggcgcgcagauguggugggcguggccaccggcugccguguagugggg

SEQ ID NO: 2716 - RNA, 56 nt, Human herpesvirus 1
cgcacguggugccguuugcugcagguguccggcggaaccuggggcaugcaccugcg

SEQ ID NO: 2717 - RNA, 56 nt, Human herpesvirus 1
acaccugugaaggcugggugugugaacuuugacuauucgcgcacccgccgcugugu

SEQ ID NO: 2718 - RNA, 77 nt, Human herpesvirus 1
ggcugcuccgugcuggccgcgggguuggggucgugggucgucacggcccgaagaugcguggcuaggcgcggggggcu

SEQ ID NO: 2719 - RNA, 67 nt, Human herpesvirus 1
cgccgccgucucccgggggagguuaaagacgggcgacauccaaaagucccgggggaacucgggggug

SEQ ID NO: 2720 - RNA, 55 nt, Human herpesvirus 1
cgccguggucggggugcgccgccgcuucggcggacacgaccgcuucggccaggcg

SEQ ID NO: 2721 - RNA, 55 nt, Human herpesvirus 1
uguaguguagggcgggguugauggcgaacacggggcugcauagcuugcggaugcg

SEQ ID NO: 2722 - RNA, 58 nt, Human herpesvirus 1
gcccgcccgggccgccgagcggcccgucuccggacgccucuccggaggcccggggggc

SEQ ID NO: 2723 - RNA, 62 nt, Human herpesvirus 1
caucgggccagauucacgcuucccagguugcagaccccacuggaucgcuuggaggccggaug

SEQ ID NO: 2724 - RNA, 55 nt, Human herpesvirus 1
augugcgucgcguuguaccugcgggcgaagaugcgguccauggcgucgcgggcgu

SEQ ID NO: 2725 - RNA, 71 nt, Human herpesvirus 1
gccggcgagcggguccggacggggcccggaccgccgcggucgggggccccucgucccgggccguacgcggc

SEQ ID NO: 2726 - RNA, 56 nt, Human herpesvirus 1
cggugagcuuguagccgaucccccggggcagaggggagugggugacgacguagcug

SEQ ID NO: 2727 - RNA, 55 nt, Human herpesvirus 1
cggcgccgauuuccggcccggcgcguccccgcggggccgguccagaucgcggucg

SEQ ID NO: 2728 - RNA, 56 nt, Human herpesvirus 1
ccuggccuggcccccgaugaucuccugcaugaaggaaucggccagaaacaaaucgg

SEQ ID NO: 2729 - RNA, 56 nt, Human herpesvirus 1
cggcgcgagccgggccgacgacgcgaugaugggucggggccagcuccaucaggccg

SEQ ID NO: 2730 - RNA, 56 nt, Human herpesvirus 1
cggggcgcuggagauaacggcccccggggaacgggggaccggggcuggguaucccg

SEQ ID NO: 2731 - RNA, 86 nt, Human herpesvirus 1
accagcguccgccgagucuucggggcccggcccauugggcgggaguuaccgcccaaugggccgggccgcccacuucccgguauggu

SEQ ID NO: 2732 - RNA, 86 nt, Human herpesvirus 1; identical to SEQ ID NO: 2731

SEQ ID NO: 2733 - RNA, 91 nt, Human herpesvirus 1
gggcggccgcgggcgcgcuccugaccgcggguuccgaguugggcguggagguuaccugggacugugcgguugggacggcgcccgugggccc

SEQ ID NO: 2734 - RNA, 56 nt, Human herpesvirus 1
gggcgggccugcgccgcggcggcccggggcgccgcgggcugggcgggggcgggcuc

SEQ ID NO: 2735 - RNA, 56 nt, Human herpesvirus 1; identical to SEQ ID NO: 2734

SEQ ID NO: 2736 - RNA, 55 nt, Human herpesvirus 1
gcgggucaaacaugagggccggucgccaggggacggggaacagcgggugguccgu

SEQ ID NO: 2737 - RNA, 55 nt, Human herpesvirus 1; identical to SEQ ID NO: 2736

SEQ ID NO: 2738 - RNA, 56 nt, Human herpesvirus 1
cugcgugucuguucuugcguguggcugggggcuuauauguggggucccgggggcgg

SEQ ID NO: 2739 - RNA, 56 nt, Human herpesvirus 1; identical to SEQ ID NO: 2738

SEQ ID NO: 2740 - RNA, 83 nt, Human herpesvirus 1
uugugugugugggaagaaagaaaagggaacacaaacucccccggguguccgcggccuguuuccucuuuccuuucccgugacaa

SEQ ID NO: 2741 - RNA, 70 nt, Human herpesvirus 1
gggcuggggcggcggguagccuucgcgggagauacugcguuuuuuugcgccggccccgucgcucccgucc

SEQ ID NO: 2742 - RNA, 85 nt, Human herpesvirus 1
guauucgagaaacggcacacacagauccgccgcgccuaccacccacaagugguagaggcgaggggggcuggguuggucucggugc

SEQ ID NO: 2743 - RNA, 104 nt, Human herpesvirus 1
cggauccguccgcgcgcuucagggccgagaaggcggcguaguuucccagcacgucgcagucgcuguacaugcuguucauggucccgaagacgccgauggcuccg

SEQ ID NO: 2744 - RNA, 55 nt, Human herpesvirus 1
ugguuuuuggauggccugggcauggaccgcauguacuggcgcgacacgaacaccg

SEQ ID NO: 2745 - RNA, 55 nt, Human herpesvirus 1
accaucccggagguaaguugcagcagggcgucccggcagccggcgggcgauuggu

SEQ ID NO: 2746 - RNA, 72 nt, Human herpesvirus 1
gguguguaggcgaugcgggucccccgaguccgcgggaagggcguggguuuggcgcgcguaugcguauucgcc

SEQ ID NO: 2747 - RNA, 76 nt, Human herpesvirus 1
cgcguaucggcgucccggcgcggcgagcgucugacggucugucucuggcggucccgcgucgggucguggauccgug

SEQ ID NO: 2748 - RNA, 76 nt, Human herpesvirus 1; identical to SEQ ID NO: 2747

SEQ ID NO: 2749 - RNA, 95 nt, Human herpesvirus 1
guggugaugucggcgcggcucagcuggugggaguacgcguacuccucgaaguacacguagcccccaccgaaggugaaguagcgccggugucccac

SEQ ID NO: 2750 - RNA, 56 nt, Human herpesvirus 1
gccuuggaacggggacggauuuauacguuggguuaguucccuccgcccacccaggc

SEQ ID NO: 2751 - RNA, 55 nt, Human herpesvirus 1
gccguggaggagcucggggggcgcguggcccaacacgccgaccugagcgcccggc

SEQ ID NO: 2752 - RNA, 56 nt, Human herpesvirus 1
ccccuacgcgaucucauacggcggccagcucgaccgguacggagauuccgacgggg

SEQ ID NO: 2753 - RNA, 55 nt, Human herpesvirus 1
gccuucgcucuccauccugcaucagggccggggcuucggggugaaugagcugggc

SEQ ID NO: 2754 - RNA, 56 nt, Human herpesvirus 1
acguucgagcucgggguuaacggcaaauuuuccguguucaccacgaguaccugcgu

SEQ ID NO: 2755 - RNA, 55 nt, Human herpesvirus 1
gcccuggcccagcugguugaugacuuuacccugaccggcccggagcugggcgggc

SEQ ID NO: 2756 - RNA, 56 nt, Human herpesvirus 1
uuauugggaggcgcggguaggcggguagcuuuacaaugcaaaagccuucgacgugg

SEQ ID NO: 2757 - RNA, 55 nt, Human herpesvirus 1
ccccuggcgcuauguccggcggcguuccgggacgcccggggccuggagcuggggg

SEQ ID NO: 2758 - RNA, 55 nt, Human herpesvirus 1
ggccuucgggacauccagcgacgucgaguuuaacuguacggcggacaaccuggcc

SEQ ID NO: 2759 - RNA, 56 nt, Human herpesvirus 1
cgccuucuacgcgcgcuaucgcgacggguacgucagcggggagccguggcccggcg

SEQ ID NO: 2760 - RNA, 55 nt, Human herpesvirus 1
cgucuuucacggcggccggcaccuggaccccagcacccaggccccgaaccugacg

SEQ ID NO: 2761 - RNA, 55 nt, Human herpesvirus 1
ggaguuuuucucgggggacgcgggcgccgagcagggcccgcgccccccucucuuc

SEQ ID NO: 2762 - RNA, 55 nt, Human herpesvirus 1
gagagcggcuuggugcggagcucccgggagcuccgcggaagacccaggccgccuc

SEQ ID NO: 2763 - RNA, 55 nt, Human herpesvirus 1
caaaucggcggcgcgggccgugucaacguccacgugugcugcgcugcuggcguug

SEQ ID NO: 2764 - RNA, 55 nt, Human herpesvirus 1
gauaccucgagacccggucgauuucacccaucgacuggucgguuugaaaggcauc

SEQ ID NO: 2765 - RNA, 84 nt, Human herpesvirus 1
cgcagacggcgccggccacgaacgacgggagcggcugcggagcacgcggaccgggagcgggagucgcagagggccgucggagcg

SEQ ID NO: 2766 - RNA, 55 nt, Human herpesvirus 1
cacagcgcuuccguguccccccgcgcacgcguagugggggcccgcgagcguggug

SEQ ID NO: 2767 - RNA, 57 nt, Human herpesvirus 1
cgcagcacauccuccacggaggcguagguguuauugggauggaggucgguguggcag

SEQ ID NO: 2768 - RNA, 56 nt, Human herpesvirus 1
gucaaaguucacacacccagccuucacagguguguggcuggcggccugcuugcgac

SEQ ID NO: 2769 - RNA, 102 nt, Human herpesvirus 1
cgcaucgagcgccgccgggcccgcgcggcgguggccggccgcgacgccacgggccgcuucacggccgggcagccccggcgggucgagcuggacgccgacgcg

SEQ ID NO: 2770 - RNA, 56 nt, Human herpesvirus 1
gccacgaucacguacgggauccgguccuugauggacgggaccugcgcgcggcgggc

SEQ ID NO: 2771 - RNA, 56 nt, Human herpesvirus 1
gggagcaguaggccuccagggcggcggccgcgggcgccgccguguggcugggcccc

SEQ ID NO: 2772 - RNA, 56 nt, Human herpesvirus 1; identical to SEQ ID NO: 2771

SEQ ID NO: 2773 - RNA, 100 nt, Human herpesvirus 1
cccaggccggccgcguggccgucgagugccuggccgccugccgcgggauccuggaggcgcuggccgagggcuucgacggcgaccuggcggccgucccggg

SEQ ID NO: 2774 - RNA, 55 nt, Human herpesvirus 1
uggaaccggccgccauguugggggacccccacucauacacgggagccgggcgcca

SEQ ID NO: 2775 - RNA, 55 nt, Human herpesvirus 1; identical to SEQ ID NO: 2774

SEQ ID NO: 2776 - RNA, 55 nt, Human herpesvirus 1
gcuaacccagcucccgccguugcguucacgccaaccgccgggccgggacuggagc

SEQ ID NO: 2777 - RNA, 57 nt, Human herpesvirus 1
agaaacuacuaugggccguggaaccccuggaugggugcggccccuuacacccgucgu

SEQ ID NO: 2778 - RNA, 56 nt, Human herpesvirus 1
agcacgcggcccccuagaaacucggcauacagggcgucgaugagaugggcugcgcu

SEQ ID NO: 2779 - RNA, 78 nt, Human herpesvirus 1
gacacgcucgcgccagaggggcgagguccguuucguccaguacgacgagucggauuaugcccucuacgggggcucguc

SEQ ID NO: 2780 - RNA, 56 nt, Human herpesvirus 1
gcgaccccgcgcugacggacgauugggcaccggucacccugcggcgcggcagcgau

SEQ ID NO: 2781 - RNA, 55 nt, Human herpesvirus 1
cccaccagcgcgccccgccaggccggcagaccgagcggcugggcgaggccugggg

SEQ ID NO: 2782 - RNA, 56 nt, Human herpesvirus 1
cggacuugccguuaacuaguuaccaauaaagcuuuauuauguuacgcccacccccg

SEQ ID NO: 2783 - RNA, 85 nt, Human herpesvirus 1
ggaagaggggggagaaaggggucugcaaccaaagguggucuggguccguccuuuggaucccgaccccucuucuucccucuucucc

SEQ ID NO: 2784 - RNA, 77 nt, Human herpesvirus 1
accagggcuaugauggacgcggggauggcuaucuggauuaucugggucaccguuagcgcguaucgcgagucgcgggu

SEQ ID NO: 2785 - RNA, 56 nt, Human herpesvirus 1
uggagcgacggcgccccguugcggagcagauccgcggccagggcggccccgaacca

SEQ ID NO: 2786 - RNA, 55 nt, Human herpesvirus 1
gggaggacgagguguuucuggacagcgugugucuucuaaacccgaacgugagcuc

SEQ ID NO: 2787 - RNA, 55 nt, Human herpesvirus 1
gggaugucuuacuguauaucuuuuuaaauaaaccagguaauaccaaauaagaccc

SEQ ID NO: 2788 - RNA, 153 nt, Human herpesvirus 1
cgccgccggggcgaggcguaccugcgagugagcggaggcccggggccccuggugcugcgcgaggccaccaguacgcuggaucggccguucgcccccagcuuuuuggucccggauggaacgccacugcaguacgcgcucugcuucccggccgug

SEQ ID NO: 2789 - RNA, 56 nt, Human herpesvirus 1
cugcgccgcggcggcgucgcguccggugcgggggcuggcguuguugauggccacgg

SEQ ID NO: 2790 - RNA, 71 nt, Human herpesvirus 1
cgccaaggccacaggccagacgggcgcgggcgcggcggccgcgcccgcgccccugcucguggaucuucgcg

SEQ ID NO: 2791 - RNA, 55 nt, Human herpesvirus 1
gcgccgccaugacgggccgcagcagguugcagcuggcgaacauggacguccacgc

SEQ ID NO: 2792 - RNA, 71 nt, Human herpesvirus 1
gagccccugcccgacagggccgugcccauuuacguggcuggguuuuuggcccuguaugacagcggggacuc

SEQ ID NO: 2793 - RNA, 56 nt, Human herpesvirus 1
cuccgggggacaaagggccgggugggucguuguugguuccggcucccccaccugag

SEQ ID NO: 2794 - RNA, 64 nt, Human herpesvirus 1
ggccgucugguucgaggauaugacccccgccgagcuggagguugucuucccgacuacggacgcc

SEQ ID NO: 2795 - RNA, 56 nt, Human herpesvirus 1
cgccgcccaccccgagcccagaccgcgacgagcggggggcccucggguggggcgcg

SEQ ID NO: 2796 - RNA, 56 nt, Human herpesvirus 1
gcgccccaaccccagccgcauuccgcguuugguuucccggcugcggcgggguccgu

SEQ ID NO: 2797 - RNA, 65 nt, Human herpesvirus 1
uugcgcaacaccugcccgcugugcaacgccaagcugguguaccugauagugggcgugacgcccag

SEQ ID NO: 2798 - RNA, 56 nt, Human herpesvirus 1
gcccagacgcccuccgaggagaucgccaucgugcgcucgcucucggugccccuggu

SEQ ID NO: 2799 - RNA, 63 nt, Human herpesvirus 1
gcgcgccacggccuccgcguucucgggcgugaguuccagggggacgggguaggccgugcccgu

SEQ ID NO: 2800 - RNA, 56 nt, Human herpesvirus 1
ucccgccaugcgccagggcgcccccgcgcgggggcgccggugguucgucguauggg

SEQ ID NO: 2801 - RNA, 56 nt, Human herpesvirus 1
cgccguccccuuacaguuccaccgaacccggcccgggggacucacuacccaccgcg

SEQ ID NO: 2802 - RNA, 56 nt, Human herpesvirus 1
ccgcgugaucagggcguacugcugcgcggcgucgcccagcucgggcgcccacacgg

SEQ ID NO: 2803 - RNA, 55 nt, Human herpesvirus 1
cuccaguuucuguugucgguguucccccauacccacgcccacauccaccguaggg

SEQ ID NO: 2804 - RNA, 55 nt, Human herpesvirus 1
ccgcccgugcgccgucgacgggaaggcccgcgagcccgacgacggcgcgcgucgg

SEQ ID NO: 2805 - RNA, 55 nt, Human herpesvirus 1
ucgccauuuuggaugguaugguccagaugcuggggggccaucagcaggauuccgg

SEQ ID NO: 2806 - RNA, 56 nt, Human herpesvirus 1
uuuccggagccagcguugccggugauaagauacaccgcgaacggaaacucccugag

SEQ ID NO: 2807 - RNA, 56 nt, Human herpesvirus 1
augccguuguguugguaggaaagcggcucagggggaggcguuuugcuccacgccgu

SEQ ID NO: 2808 - RNA, 87 nt, Human herpesvirus 1
gcgccuugcguggggcucgggggcgagcugugcccgcgugauucuguuuaguuacgacgagcucgucccccccaacacgcgcuacgc

SEQ ID NO: 2809 - RNA, 56 nt, Human herpesvirus 1
ggccuaccuuagccucucggaccccgucgcgcgggccgcuguccuuagguuuuguc

SEQ ID NO: 2810 - RNA, 55 nt, Human herpesvirus 1
gcccucccgcccguggcaccaggcccugcggggucuuaagcaccuacggauuggc

SEQ ID NO: 2811 - RNA, 75 nt, Human herpesvirus 1
cgucucuccggagagcggcuuggugcggagcucccgggagcuccgcggaagacccaggccgccucggguguaacg

SEQ ID NO: 2812 - RNA, 67 nt, Human herpesvirus 1
gcccuguuugggaauaacgccaagaucaccgagagucuguuaaaaagguuuauucccgaaguguggc

SEQ ID NO: 2813 - RNA, 56 nt, Human herpesvirus 1
gccgccgccccccggccccggcccccaccgcccggcgugggcccggggggcggggc

SEQ ID NO: 2814 - RNA, 68 nt, Human herpesvirus 1
gugguggccuggggguuuaccagguagcagcuggagguguaguaguugcggguccccagguucagcau

SEQ ID NO: 2815 - RNA, 70 nt, Human herpesvirus 1
cucggaggcggagucgucgucaugguggucggcguccccccgcccccccacuucggucuccgccucagag

SEQ ID NO: 2816 - RNA, 55 nt, Human herpesvirus 1
accgccgggcgagcggcgucgaguaucggcuccgguccguccucuccgugggggu

SEQ ID NO: 2817 - RNA, 57 nt, Human herpesvirus 1
ccggccuccgcguuggaugccuccgguugggauccgguggcggcgggggggaacgcg

SEQ ID NO: 2818 - RNA, 55 nt, Human herpesvirus 1
ggcggcgugccgcccgccguguccuccccgggacuggcgggcgcaaacgcgggcc

SEQ ID NO: 2819 - RNA, 61 nt, Human herpesvirus 1
gcugauguugguguugacgacggacaugaagccguguuggucccgcaagaccacguaaggc

SEQ ID NO: 2820 - RNA, 56 nt, Human herpesvirus 1
gaggaaaauaaaauuacaucaccuacccacguggugcuguggccuguuuuugcugc

SEQ ID NO: 2821 - RNA, 55 nt, Human herpesvirus 1
gccgccgaacccggcggucccgggaggcguacggggccgaggccgggcugggggu

SEQ ID NO: 2822 - RNA, 84 nt, Human herpesvirus 1
ugagucaguggggaccacgcccccaacacggcgaccccgguccuuguguguuuguugugggggcgugucucuguguaugaguca

SEQ ID NO: 2823 - RNA, 55 nt, Human herpesvirus 1
cccgagcggcccgucaagcuuccccaaauauaucgacuggcugacgugccugggg

SEQ ID NO: 2824 - RNA, 63 nt, Human herpesvirus 1
caugacgcccggcucgcgugggugggggacagcguagaccaacgacgagaccgggcgggaaug

SEQ ID NO: 2825 - RNA, 56 nt, Human herpesvirus 1
ggagaaacucccgcacggccccuugggugcccugggggugcgggugguuguuaucc

SEQ ID NO: 2826 - RNA, 55 nt, Human herpesvirus 1
uccgaacgcagccccgcuggaacuacuaugacagcuucagcgccgucagcgagga

SEQ ID NO: 2827 - RNA, 56 nt, Human herpesvirus 1
cgcgccccacccgagggccccccgcucgucgcggucugggcucggggugggcggcg

SEQ ID NO: 2828 - RNA, 55 nt, Human herpesvirus 1
gucgcguuuacgggggacagggcaggaggaaggaggaggccgucccgccggagac

SEQ ID NO: 2829 - RNA, 56 nt, Human herpesvirus 1
cguggaaguacucgcgagcgcgggggggcagccauaccgcguaaaggguaauggcg

SEQ ID NO: 2830 - RNA, 56 nt, Human herpesvirus 1
cguugcggagcaucccgcgccuuggccgugauggcacgcggggugguuccgucacg

SEQ ID NO: 2831 - RNA, 88 nt, Human herpesvirus 1
gcgugccggggugguagaguuugacaggcaagcaugugcgugcagaggcgaguagugcuugccugucuaacucgcuagucucggccgc

SEQ ID NO: 2832 - RNA, 70 nt, Human herpesvirus 1
cucugaggcggagaccgaagugggggggcggggggacgccgaccaccaugacgacgacuccgccuccgag

SEQ ID NO: 2833 - RNA, 70 nt, Human herpesvirus 1; identical to SEQ ID NO: 2832

SEQ ID NO: 2834 - RNA, 55 nt, Human herpesvirus 1
gcgucugguaugcgguugguauauguacacuuuaccugggggcgugccgguccgc

SEQ ID NO: 2835 - RNA, 71 nt, Human herpesvirus 1
accugccagaugacguggcaucgcgacuccgugacguucucgcgacgcaaugccaccgggcuggcccuggu

SEQ ID NO: 2836 - RNA, 62 nt, Human herpesvirus 1
gcguccagcgucuggccccgcuggaucagaucccgcaacaggauggccguggggcuggucgc

SEQ ID NO: 2837 - RNA, 55 nt, Human herpesvirus 1
gcguacgaagggauguacgggugcugaaagcuguuggcgacguacgugucgucgu

SEQ ID NO: 2838 - RNA, 55 nt, Human herpesvirus 1
uggugccucagcguaacgccuacuauagcguucugaauacguuucaggcccucca

SEQ ID NO: 2839 - RNA, 55 nt, Human herpesvirus 1
cgaucuucggacgggcggcucugccccgccguccccguguucguccacgaguucg

SEQ ID NO: 2840 - RNA, 56 nt, Human herpesvirus 1
gguugcaccaccaggaccaccgaggccacuuggcgagccggguccuuuaugucgcc

SEQ ID NO: 2841 - RNA, 55 nt, Human herpesvirus 1
uggucguuaaugucgcggaugcugcgcgccagcucguccaguggcuugcguucua

SEQ ID NO: 2842 - RNA, 60 nt, Human herpesvirus 1
ggguguguuuuggggggggcccguuuucggcgucuggccgcuccuccccccgcuccuccc

SEQ ID NO: 2843 - RNA, 56 nt, Human herpesvirus 1
gccugcagucccucgggcaggggucgcgccagccacuccuccgcggggcgcucggc

SEQ ID NO: 2844 - RNA, 55 nt, Human herpesvirus 1
gugucgcagcgcagguggggcgcgaucucauccgugcacacggcgcacacgucgc

SEQ ID NO: 2845 - RNA, 55 nt, Human herpesvirus 1
gguuagggaguuguucggucauaagcuucagcgcgaacgaccaacuaccccgauc

SEQ ID NO: 2846 - RNA, 55 nt, Human herpesvirus 1
ggcuccuggccaggaucaccaaccacccggggggcugcgaguccugcgccccgcc

SEQ ID NO: 2847 - RNA, 77 nt, Human herpesvirus 1
gguucgguucggcccgaguggaccacguuaaaggggaaaccaucuccuucucguuuccggacgggucgcgcaguacc

SEQ ID NO: 2848 - RNA, 74 nt, Human herpesvirus 1
cgauuacgcguuucucugugccaaaugccugggggcgccccacugcgccgcuagcaucuucguggccgcguucg

SEQ ID NO: 2849 - RNA, 70 nt, Human herpesvirus 1
caaggaccuggagcccuucccccccgcccccguaagcggcggguccguguugggcccgcggguccgcgug

SEQ ID NO: 2850 - RNA, 65 nt, Human herpesvirus 1
ccagcggccggccggcgcuuagggggaggaugucgccgacgccccuuggccgccccggcugcagg

SEQ ID NO: 2851 - RNA, 55 nt, Human herpesvirus 1
ggaggguuggagaccgggguuggggaaugaaucccuccccuucaccgacaacccc

SEQ ID NO: 2852 - RNA, 55 nt, Human herpesvirus 1
gcacagacucuguucuugguucgcggccugagccagggacgagugcgacuggggc

SEQ ID NO: 2853 - RNA, 56 nt, Human herpesvirus 1
agagcucggcaugaugcccgaggauaguccccgcugccugcaccgcaccgagcgcu

SEQ ID NO: 2854 - RNA, 81 nt, Human herpesvirus 1
guacacccccuggcccucgguauaccccagcugcccguggagaaucucgcggaacagcaucguaccggggcuggggugaac

SEQ ID NO: 2855 - RNA, 56 nt, Human herpesvirus 1
ccacacacaccaacacgggccgcaggcgggccgcguacuggggggugugguacagg

SEQ ID NO: 2856 - RNA, 55 nt, Human herpesvirus 1
cgaggugcgccaggucggcgaccgccagccgcgguuuaccgccaccagcaucgcg

SEQ ID NO: 2857 - RNA, 67 nt, Human herpesvirus 1
guacugcaccucgcugcgaaccagcccgggugugcuaauauccgggcugcgcgugcgggcgcaggac

SEQ ID NO: 2858 - RNA, 86 nt, Human herpesvirus 1
cgaggggaacgggggauggaaggacgggaaguggaaguccugauacccauccuacaccccccugccuuccacccuccggccccccg

SEQ ID NO: 2859 - RNA, 56 nt, Human herpesvirus 1
cgagugcgccguguugugucucuaccugcuguaccgaaacacgcacggggccgccg

SEQ ID NO: 2860 - RNA, 134 nt, Human herpesvirus 1
ggagaacgaggagauccucgcguugguucagcgggcagugcaggacgucacccgccgccacccgguccgagcgcggaccgggcgugcggccuguggcguugcaucggggcuacgccagggcgcccugguucacc

SEQ ID NO: 2861 - RNA, 56 nt, Human herpesvirus 1
cgagggcgcggcggacggcagcgcggcuccggacccggccgucccccggguccccg

SEQ ID NO: 2862 - RNA, 55 nt, Human herpesvirus 1
gcagccccgaggaggccgugcuccuggacaagcagcaggccgccaucaaggucgu

SEQ ID NO: 2863 - RNA, 55 nt, Human herpesvirus 1
auauccccgacucgugguuuggcgugucgaacguccagccccacgaggcuagaau

SEQ ID NO: 2864 - RNA, 55 nt, Human herpesvirus 1
gcaaucagcgguucgccccgcgguaccugacccugggggggcacacggugagggc

SEQ ID NO: 2865 - RNA, 71 nt, Human herpesvirus 1
ggaaagcgaagaggaagcgguaaaagcugagcucgcccucggaaagcuuggagacguccuccucguccccc

SEQ ID NO: 2866 - RNA, 56 nt, Human herpesvirus 1
gcacggcccgcacgcguacggguccagcgucagggacauggcgugguuggccucgc

SEQ ID NO: 2867 - RNA, 55 nt, Human herpesvirus 1
ggacgaaucggaggccugggaguaacggcgaucgggccuuccggauccaaagguu

SEQ ID NO: 2868 - RNA, 55 nt, Human herpesvirus 1
gaacagguucuucagcaccaccacgaagcugggaugcaagccagacagagccguc

SEQ ID NO: 2869 - RNA, 56 nt, Human herpesvirus 1
ccacccggagcccaccacggacgaggaugacgacgaccuggacgacggugaggcgg

SEQ ID NO: 2870 - RNA, 98 nt, Human herpesvirus 1
gcagagagccucguuaagagccaggaggcugggaucgaaggccacauacgcgcgcucgaacgcccccgccuuccagcugcugccgggggacucuucgc

SEQ ID NO: 2871 - RNA, 55 nt, Human herpesvirus 1
ccagguggcgcacccggacguggggcgagaagcgcacccgcgcgggggucgcggg

SEQ ID NO: 2872 - RNA, 56 nt, Human herpesvirus 1
gcaggcucgcguucgggggccggccgagcagguaggucuucgggauguaaagcagc

SEQ ID NO: 2873 - RNA, 55 nt, Human herpesvirus 1
acauaccgcccggcucgaucgcugccgcgccgcagggugaccggugcccaaucgu

SEQ ID NO: 2874 - RNA, 55 nt, Human herpesvirus 1
agcguucgcacuucgucccaauauauauauauuauuagggcgaagugcgagcacu

SEQ ID NO: 2875 - RNA, 56 nt, Human herpesvirus 1
ggcgcuuuggcacccagucccaggccacggugaacuugggggucgugagcagguuc

SEQ ID NO: 2876 - RNA, 94 nt, Human herpesvirus 1
ggcgaccccggucccuguauauauagggucaggggguuccgcacccccuaacauggcgcccccggucccuguauauauagugucacgggguucc

SEQ ID NO: 2877 - RNA, 56 nt, Human herpesvirus 1
cacccggagguuccggaggcgccgcgcggacggcgcggggcccccgcuuccggaug

SEQ ID NO: 2878 - RNA, 56 nt, Human herpesvirus 1
ggcgagcugcucgccgccaagcgggaaagauucgcggcggucauuaaccgguuccu

SEQ ID NO: 2879 - RNA, 56 nt, Human herpesvirus 1
ugccgcggcucuccgggccccccugcagccggggcggccaaggggcgucggcgaca

SEQ ID NO: 2880 - RNA, 55 nt, Human herpesvirus 1
accgccgaugacgcugccgcgacugugaugugcggacgacguacacgauugccgu

SEQ ID NO: 2881 - RNA, 55 nt, Human herpesvirus 1
ucccggguacgaccaucacccgagucucugggcggagggugguucccccccgugg

SEQ ID NO: 2882 - RNA, 55 nt, Human herpesvirus 1
accgccuuaucuuggacgcguuuaauaaacgguuggacgcggaguacuggagcgu

SEQ ID NO: 2883 - RNA, 78 nt, Human herpesvirus 1
gccgccacccacaucgaggccccggccgcgcaggcuauccccagggcccgugugcgcaggggaucggugggcggcagc

SEQ ID NO: 2884 - RNA, 55 nt, Human herpesvirus 1
accaggagaggcuuaagcucgggaggcagcgccaccgacgacaguaucgccuugu

SEQ ID NO: 2885 - RNA, 56 nt, Human herpesvirus 1
cccgcgcauggugccccgcaggaucuuguccagggccuguucgguaucgucguugg

SEQ ID NO: 2886 - RNA, 67 nt, Human herpesvirus 1
gccgcaccgucccccgacgaccucuugcagacgguccgugaugcaaggacggcggggggccugcagc

SEQ ID NO: 2887 - RNA, 55 nt, Human herpesvirus 1
acccagccccccucgccucuaccacuugugggugguaggcgcggcggaucugugu

SEQ ID NO: 2888 - RNA, 55 nt, Human herpesvirus 1
cgcaacggcgggagcuggguuagcguuuaguuuagcauucgcucucgccuuuccg

SEQ ID NO: 2889 - RNA, 55 nt, Human herpesvirus 1
cccaaccgcacagucccagguaaccuccacgcccaacucggaacccgcggucagg

SEQ ID NO: 2890 - RNA, 56 nt, Human herpesvirus 1
uucacggccuucgaagccagccaggguaagaccccgcggggcgggcgcgacggcgg

SEQ ID NO: 2891 - RNA, 66 nt, Human herpesvirus 1
guccggcggcagaaccgggguccguccagacguuccguugguaggucccaaauccugucgcccuac

SEQ ID NO: 2892 - RNA, 55 nt, Human herpesvirus 1
gucccgggccuucgcggccacggccaacccgugggcgucgcagcgauuuucguac

SEQ ID NO: 2893 - RNA, 56 nt, Human herpesvirus 1
gcccccgaagucucacaugugcguggggugaccgugcguauggagacuccggaagc

SEQ ID NO: 2894 - RNA, 55 nt, Human herpesvirus 1
acccaucaucgcgucgucggcccggcucgcgccgugcugacaaacgccuugcugu

SEQ ID NO: 2895 - RNA, 56 nt, Human herpesvirus 1
gccccagcccuccccggccccagcccuccccggccccagcccuccccggccccagc

SEQ ID NO: 2896 - RNA, 56 nt, Human herpesvirus 1
gccccagccccagccccagccccagccccagccccagccccagccccagccccagc

SEQ ID NO: 2897 - RNA, 55 nt, Human herpesvirus 1
ggccucgauguggguggcggcggcggacagcuuugccgccucugccaauuucuuc

SEQ ID NO: 2898 - RNA, 55 nt, Human herpesvirus 1
ggcgccaaggucgcccagcuccugguugcgggggcggacgcucuuccuuggaucc

SEQ ID NO: 2899 - RNA, 55 nt, Human herpesvirus 1
gccggccgcggcucggacagcgccccccucggcgcccaucgggccacacggcagc

SEQ ID NO: 2900 - RNA, 55 nt, Human herpesvirus 1
gucucgaacaguuccguguccgugcuguccgccucggaggcggagucgucgucau

SEQ ID NO: 2901 - RNA, 68 nt, Human herpesvirus 1
ggggagugagggucgcgucgucuaugcgcuggaggugcgccgagaacagcgucacccgauuacucacc

SEQ ID NO: 2902 - RNA, 55 nt, Human herpesvirus 1
cuguaccccguggugcacggcguuugccgccuacgugcccgcggaugcggugggg

SEQ ID NO: 2903 - RNA, 88 nt, Human herpesvirus 1
gggucggcgguucgcggguggcgccgucgccgcuguuccuagaggagcugcaguacgaggaggacgacuacccggaagccgucgggcc

SEQ ID NO: 2904 - RNA, 69 nt, Human herpesvirus 1
guggccgucgagugccuggccgccugccgcgggauccuggaggcgcuggccgagggcuucgacggcgac

SEQ ID NO: 2905 - RNA, 119 nt, Human herpesvirus 1
gcggucucggauccguccgcgcgcuucagggccgagaaggcggcguaguuucccagcacgucgcagucgcuguacaugcuguucauggucccgaagacgccgauggcuccgcgggcggc

SEQ ID NO: 2906 - RNA, 55 nt, Human herpesvirus 1
gggccgugauaugccgggucacgauagaucgcgccagguuuucgucgcggauguc

SEQ ID NO: 2907 - RNA, 67 nt, Human herpesvirus 1
ucgagcgccgguuacgcccgaucgaacggaacgugcacgagaucgcaggcgcccuggaggcgcugga

SEQ ID NO: 2908 - RNA, 56 nt, Human herpesvirus 1
gugucuauaucucugggcgggccgugauuccucuccgcggugucugggaauagagc

SEQ ID NO: 2909 - RNA, 55 nt, Human herpesvirus 1
gugccgccagacacgcguuuucgaucggguucaggucggcgugcaggaggcggac

SEQ ID NO: 2910 - RNA, 56 nt, Human herpesvirus 1
cggcggcccgugauaaccacauccgugcgcggguugugggcgucaaguggcuggcg

SEQ ID NO: 2911 - RNA, 81 nt, Human herpesvirus 1
gugcgccaguuccugcugcagagacgucaccgcccccaucagcgccgugauggucucguuggucccgggagaauggcgggc

SEQ ID NO: 2912 - RNA, 56 nt, Human herpesvirus 1
gugugugcuugagucuguccgaauacgugccgacuugccccccuccccgcacagau

SEQ ID NO: 2913 - RNA, 72 nt, Human herpesvirus 1
gggugguagaguuugacaggcaagcaugugcgugcagaggcgaguagugcuugccugucuaacucgcuaguc

SEQ ID NO: 2914 - RNA, 55 nt, Human herpesvirus 1
ucgaugugggggugaccuccgggcuggcggcugacccgggggaccccgauguggg

SEQ ID NO: 2915 - RNA, 55 nt, Human herpesvirus 1
cugggccuaccguggacuccauuuccgagacgacguggggggagcggugguugag

SEQ ID NO: 2916 - RNA, 105 nt, Human herpesvirus 1
gggcucaacggcgggggcgggggcccggugcggcccgggggggaaaauagggcggaucccccccagucguacaggggauuuuccgccucaauguacggggaggcc

SEQ ID NO: 2917 - RNA, 55 nt, Human herpesvirus 1
gggcggguacuggcccuugggcgcgcggacgcaauggggcaggaagacgggaacc

SEQ ID NO: 2918 - RNA, 70 nt, Human herpesvirus 1
gcgguucggggggggggggggggggcgggaaaccaaguaggcccgcccauccgcggccccucccggcagc

SEQ ID NO: 2919 - RNA, 87 nt, Human herpesvirus 1
ccgacucucccaccgccaucagccuuaccacgcccgaccacacaccccccaugccaaguauuggacuggaggaggaggaagaggagg

SEQ ID NO: 2920 - RNA, 56 nt, Human herpesvirus 1
gggaaguugcggucgcugugacucacgauuuuuaauuugcugcggcuaggcggacc

SEQ ID NO: 2921 - RNA, 56 nt, Human herpesvirus 1
ccgccgguccgcggacgaccacguaccgaacgagugcggucccgagacuuauaggg

SEQ ID NO: 2922 - RNA, 56 nt, Human herpesvirus 1
cgggugggugugcgggacgcgccuucacgcggaggcgcgcgggucugaccuggacg

SEQ ID NO: 2923 - RNA, 62 nt, Human herpesvirus 1
gcggggggaggagcggggggaggagcggggggaggagcggggggaggagcggggggaggagc

SEQ ID NO: 2924 - RNA, 80 nt, Human herpesvirus 1
gcugggcgacaccgcagcgcgccggcugcucgccaacagcgggcucaacgccgugcugggcgcugcgguguacgcgcugc

SEQ ID NO: 2925 - RNA, 56 nt, Human herpesvirus 1
ucuucgggggugccgacgcaggcgucgguaauggccgacgcaggcgcccccggcga

SEQ ID NO: 2926 - RNA, 57 nt, Human herpesvirus 1
gcuggcggcggcggccagcgcaccggacgccgccgacgcgcuggcggccgccgccgc

SEQ ID NO: 2927 - RNA, 57 nt, Human herpesvirus 1; identical to SEQ ID NO: 2926

SEQ ID NO: 2928 - RNA, 81 nt, Human herpesvirus 1
guucaccccagccccgguacgaugcuguuccgcgagauucuccacgggcagcugggguauaccgagggccaggggguguac

SEQ ID NO: 2929 - RNA, 55 nt, Human herpesvirus 1
aguugugaucauugccgcguugguccucgugcccucgcgggccucgugggcacuu

SEQ ID NO: 2930 - RNA, 89 nt, Human herpesvirus 1
ucugguucgccaacacgaguacaugcaucucacccucccccgugcguuucagaacgcagcagauuccaugcuauucgugcagcgccuga

SEQ ID NO: 2931 - RNA, 55 nt, Human herpesvirus 1
gauagcucuccucccgcgcccguagcucggcguggaagaaacgagagagcgcuuc

SEQ ID NO: 2932 - RNA, 56 nt, Human herpesvirus 1
ccuccaagagcucuucggggaggcauuugaagucgcccccuuuagcacguacgugg

SEQ ID NO: 2933 - RNA, 55 nt, Human herpesvirus 1
guugccgucgucguccucguccucgucggacgacgaggacgaagaggaugcggac

SEQ ID NO: 2934 - RNA, 55 nt, Human herpesvirus 1; identical to SEQ ID NO: 2933

SEQ ID NO: 2935 - RNA, 60 nt, Human herpesvirus 1
cguuucgguucaugggccccgaagaugccggacggacgagacggauccugugccgcgccg

SEQ ID NO: 2936 - RNA, 55 nt, Human herpesvirus 1
uaauacgcccugcgguacgcggcaagcacgcgcaccucgugguggacguauagcg

SEQ ID NO: 2937 - RNA, 56 nt, Human herpesvirus 1
cagcuccccaugaucccggcgggguuauaggccacgcagucggagcgggggggcgg

SEQ ID NO: 2938 - RNA, 57 nt, Human herpesvirus 1
cagagaccccaggguaccgcgugaccccagggauccacgacaaccccggucucccag

SEQ ID NO: 2939 - RNA, 55 nt, Human herpesvirus 1
cacgggccgcagcggcaccgugcuggcggcggcgggggccguggaggugcugggg

SEQ ID NO: 2940 - RNA, 55 nt, Human herpesvirus 1; identical to SEQ ID NO: 2939

SEQ ID NO: 2941 - RNA, 56 nt, Human herpesvirus 1
aacgcuccaguacuccgcguccaaccguuuauuaaacgcguccaagauaaggcggu

SEQ ID NO: 2942 - RNA, 60 nt, Human herpesvirus 1
aauugcccgaggcgcauaaagggccggugguccgccuagccgcagcaaauuaaaaaucgu

SEQ ID NO: 2943 - RNA, 57 nt, Human herpesvirus 1
caccggcuccggcguccuucgcguuuaagcuuggucaggagggcgcucagggcggcg

SEQ ID NO: 2944 - RNA, 57 nt, Human herpesvirus 1
gaagcgucgccgccaaccgggccccguccccgggguccuuccugugcaggcgacgcc

SEQ ID NO: 2945 - RNA, 57 nt, Human herpesvirus 1
aaagcugagucccgcccaggcgcuggcggcggugagcguccucgggcgcaugugucu

SEQ ID NO: 2946 - RNA, 60 nt, Human herpesvirus 1
uaaccggggcgaccgugucggggagggcaggcggccgccaacccuggguggucgcggaag

SEQ ID NO: 2947 - RNA, 64 nt, Human herpesvirus 1
caaagaagcucacauaguccccacccaggcugugcaggacacggaucucccggggggaagcgag

SEQ ID NO: 2948 - RNA, 65 nt, Human herpesvirus 1
uaaauuuuuagagcagcccccgcgucggccugucuccccgccgugcguggccuuacaaaucugca

SEQ ID NO: 2949 - RNA, 56 nt, Human herpesvirus 1
gacagcuuuguaaagacucagggggagacuucgguggaguuugccuacagguuccu

SEQ ID NO: 2950 - RNA, 56 nt, Human herpesvirus 1
uacgcacggguguuugccuuugcggacgagcugcggaggcggcacgcgacggccaa

SEQ ID NO: 2951 - RNA, 68 nt, Human herpesvirus 1
gacagaaacccaccgguccgccuuuuuugcacggguaagcaccuugggugggcggaggagggggggac

SEQ ID NO: 2952 - RNA, 58 nt, Human herpesvirus 1
aacauaagcuugccguuaagaccauaaaggaaaaggagugguuugccguugagcucau

SEQ ID NO: 2953 - RNA, 58 nt, Human herpesvirus 1
caccgccucgcgccccagcgccacguacacgggccgcagcggcgcgcccaggccccag

SEQ ID NO: 2954 - RNA, 55 nt, Human herpesvirus 1
gaccgccaggugcugcgccugucucuggaacacgcgaucgggaccgugugccacc

SEQ ID NO: 2955 - RNA, 57 nt, Human herpesvirus 1
gaccgcgcgccccaggucgcccauccccucgaagaacgcgcccaggcccgcaaacau

SEQ ID NO: 2956 - RNA, 58 nt, Human herpesvirus 1
gacccgccgccguggcacugcgaugccgaaacguggacgccguggcccgcgcggccgc

SEQ ID NO: 2957 - RNA, 55 nt, Human herpesvirus 1
cacguguauggccaccauccugcagauguacauguccgugggggcggcugacaag

SEQ ID NO: 2958 - RNA, 61 nt, Human herpesvirus 1
cacgcgguagcgcacguugccgccgcggcacaggcgcagcggcggcgcgucgggguacagg

SEQ ID NO: 2959 - RNA, 60 nt, Human herpesvirus 1
caguugcgugguggugguuuuccccaucccguggggaccgucuauauaaacccgcaguag

SEQ ID NO: 2960 - RNA, 59 nt, Human herpesvirus 1
gagccgcggcgcgccaggcgggcggccgaggcccagaccaccagguggcgcacccggac

SEQ ID NO: 2961 - RNA, 59 nt, Human herpesvirus 1
cagcucgcgcagccacgcgcgcaggcggggcgcgucggcgugcggcggcggcggggaag

SEQ ID NO: 2962 - RNA, 61 nt, Human herpesvirus 1
aagacgaucguccacggcguccaggcgcucaccaagcgccggaucgagguaccgucggugu

SEQ ID NO: 2963 - RNA, 68 nt, Human herpesvirus 1
gaggagcggggggaggagcggggggaggagcggccagacgccgaaaacgggccccccccaaaacacac

SEQ ID NO: 2964 - RNA, 55 nt, Human herpesvirus 1
caucagccuuaccacgcccgaccacacaccccccaugccaaguauuggacuggag

SEQ ID NO: 2965 - RNA, 56 nt, Human herpesvirus 1
cauggagccggucgugccgcugggaccccgguccagauggcgcgcgaacguuuccg

SEQ ID NO: 2966 - RNA, 59 nt, Human herpesvirus 1
gauacuccccgggugcuacaugcccguuuuggggcugggguuggggcugggguuggggc

SEQ ID NO: 2967 - RNA, 55 nt, Human herpesvirus 1
gauagccaggccuggcucagacguccguuggccguuucggguggguucugaggcc

SEQ ID NO: 2968 - RNA, 59 nt, Human herpesvirus 1
gaucccacgggccgccggccgaugaggucgcaccggccagggucgcgcggcccgaaaac

SEQ ID NO: 2969 - RNA, 60 nt, Human herpesvirus 1
gauggcgcggcucaacuggccgccgggcagcuccaccucgcccagcgccuggguggcggc

SEQ ID NO: 2970 - RNA, 58 nt, Human herpesvirus 1
uauucugucaccgggccgcugccgacccagcggcugauuaucggcgaggugacgcccg

SEQ ID NO: 2971 - RNA, 64 nt, Human herpesvirus 1
aauuccgccaacaggccccccagggugucaaaguucaucucccaggccacccuuggcaccaccu

SEQ ID NO: 2972 - RNA, 67 nt, Human herpesvirus 1
uauuuuuccuaagauggggcggguccggucuacccgggaaacgcagccccgggcccccaccccgucg

SEQ ID NO: 2973 - RNA, 57 nt, Human herpesvirus 1
ucggguggcucccgccggauccaaaugagucuucggaccucgcgggggccgcuuaag

SEQ ID NO: 2974 - RNA, 57 nt, Human herpesvirus 1
ucgaauccgaugcugucucggauucgaccucagacuccaaggcuguaucggauucua

SEQ ID NO: 2975 - RNA, 62 nt, Human herpesvirus 1
ccgggccaggcucgcggggggaggacgacccuggcccccaccgcgggccaggcccccaggag

SEQ ID NO: 2976 - RNA, 58 nt, Human herpesvirus 1
ccgccgaagaugcgccgcucgggaacgcccgcguugucgccgcggaucagguuggcag

SEQ ID NO: 2977 - RNA, 57 nt, Human herpesvirus 1
gcgggcgccauggcgggacugggcaagcccuacaccggccacccaggugacgccuuc

SEQ ID NO: 2978 - RNA, 78 nt, Human herpesvirus 1
acgguaccagccgaaggugacgaacccgggguuguccaggaugaaccgggugguggcgucgaccccacccucguacuu

SEQ ID NO: 2979 - RNA, 55 nt, Human herpesvirus 1
gcgucuacacccacgcagucgccuggagccaggcgggagugugguucuggaacuc

SEQ ID NO: 2980 - RNA, 57 nt, Human herpesvirus 1
gcucccuuagcguggggccgggcggggcggaauccugggccccgggcaccagggaac

SEQ ID NO: 2981 - RNA, 59 nt, Human herpesvirus 1
ucgcgccccagcgccacguacacgggccgcagcggcgcgcccaggccccagcgcgcgca

SEQ ID NO: 2982 - RNA, 57 nt, Human herpesvirus 1
acccacguacuccaagaaggcaugugucccaccccgccuguguuuuugugccuggcu

SEQ ID NO: 2983 - RNA, 55 nt, Human herpesvirus 1
gcugcgccuggccgaccagaagggcuuuauucugccggacacccaggggcgauuu

SEQ ID NO: 2984 - RNA, 55 nt, Human herpesvirus 1
ccgccgccgucgcgcccgccccgcggggucuuacccuggcuggcuucgaaggccg

SEQ ID NO: 2985 - RNA, 56 nt, Human herpesvirus 1
gcgucggcgggccucaccaugggcggcgaugcccuacgagugcccuuuuuagauuu

SEQ ID NO: 2986 - RNA, 56 nt, Human herpesvirus 1
gcagcaaaaacaggccacagcaccacguggguaggugauguaauuuuauuuuccuc

SEQ ID NO: 2987 - RNA, 55 nt, Human herpesvirus 1
gcggcuaacacacacgccggcaacccagaccccaguggguugguugcgcgguccc

SEQ ID NO: 2988 - RNA, 56 nt, Human herpesvirus 1
accgugggccgugccgacucgguuuuugcccgaguggaccguggcguggaccccgu

SEQ ID NO: 2989 - RNA, 56 nt, Human herpesvirus 1
cccgugggccaggcgcugcccccaggcguucaaaaacagcugcugcaugucugcgg

SEQ ID NO: 2990 - RNA, 55 nt, Human herpesvirus 1
ccaaauaaucagacgacaaccgcagguuuuguaauguaugugcucguguuuauug

SEQ ID NO: 2991 - RNA, 59 nt, Human herpesvirus 1
ccagccugaugggcggcaaaaacgcgugcccgcuccuuauuuuugaccgcacccgcaag

SEQ ID NO: 2992 - RNA, 56 nt, Human herpesvirus 1
gcaaagccccgcggccgaccgcgucgugcuuacgagccgucgcgaccuaggggccu

SEQ ID NO: 2993 - RNA, 61 nt, Human herpesvirus 1
acaccgacgguaccucgauccggcgcuuggugagcgccuggacgccguggacgaucgucuu

SEQ ID NO: 2994 - RNA, 60 nt, Human herpesvirus 1
ccaugaggaaacacccgggacggcuuugucuccggcgggacggccuccuccuuccuccug

SEQ ID NO: 2995 - RNA, 61 nt, Human herpesvirus 1
cccacgggcuuccggagacggcgcucuuggccgagaaccuccccggguugcucguacaccg

SEQ ID NO: 2996 - RNA, 55 nt, Human herpesvirus 1
gccgcagcaccgguuggaauugauugcgaaaguugcgccccucgaccgacugccc

SEQ ID NO: 2997 - RNA, 59 nt, Human herpesvirus 1
gccgggaccaacgggacggcgggcggcccaagggccgcccgccuugccgcccccccauu

SEQ ID NO: 2998 - RNA, 58 nt, Human herpesvirus 1
accaaaaacaccacaggggaccgcguguucuuuuuaucgcacgugauuguguguuuau

SEQ ID NO: 2999 - RNA, 58 nt, Human herpesvirus 1
accacggucgugcagccaucccuccgcaugcuccacgcggacgccgggcccgcggccu

SEQ ID NO: 3000 - RNA, 56 nt, Human herpesvirus 1
ucccgaacgcgcgaucgaaaugcuccgcccgccgcccgaacagcgccaguuccacg

SEQ ID NO: 3001 - RNA, 58 nt, Human herpesvirus 1
ccccgucagcgccgcguucucgcgcgccaacaggggcgcguaggcgcggcgcaggcug

SEQ ID NO: 3002 - RNA, 61 nt, Human herpesvirus 1
ucccgcgcgcuagguccuugggguaauggaaaaggcccuacuccccauccaagccagccaa

SEQ ID NO: 3003 - RNA, 62 nt, Human herpesvirus 1
gcccugcucgcccgcuucaaucccgacgccguccggugcguuuugacgcgggaggccgccuu

SEQ ID NO: 3004 - RNA, 56 nt, Human herpesvirus 1
gccuuuaacuacauuaaauuggguucgauuggcaauguugucucccgguugauuuu

SEQ ID NO: 3005 - RNA, 56 nt, Human herpesvirus 1
accuuccccgcccggucgaguucgcccugcguguguuggccugggcccgggacuuu

SEQ ID NO: 3006 - RNA, 62 nt, Human herpesvirus 1
gcgccgugcugggcuuuaugcgcgcacccccuccccucgcgcggcccaccgcgcggauauac

SEQ ID NO: 3007 - RNA, 59 nt, Human herpesvirus 1
ccgaccgggggccgauacagccgucgggggcgcucucgacgauggccaccagcggacag

SEQ ID NO: 3008 - RNA, 61 nt, Human herpesvirus 1
ucgagggggacggggugcuguaacgggccgggacggggcggggcgcuugugagacccgaag

SEQ ID NO: 3009 - RNA, 61 nt, Human herpesvirus 1; identical to SEQ ID NO: 3008

SEQ ID NO: 3010 - RNA, 56 nt, Human herpesvirus 1
ucgaauucgccaaugacaagacgcugggcgggguuugugucaucauagaacuaaag

SEQ ID NO: 3011 - RNA, 56 nt, Human herpesvirus 1
ccgacgaccauccccagggugccgacgaacaggggccccggggcgaggagaaagag

SEQ ID NO: 3012 - RNA, 57 nt, Human herpesvirus 1
acgcuauacguccaccacgaggugcgcgugcuugccgcguaccgcagggcguauuau

SEQ ID NO: 3013 - RNA, 63 nt, Human herpesvirus 1
ccgggccgaagcgcgugcgcacgcgguagcgcacguugccgccgcggcacaggcgcagcggcg

SEQ ID NO: 3014 - RNA, 58 nt, Human herpesvirus 1
gcggcgaggagcgccgccggcccugacgagcgacaggcggccgguucgccccccgaac

SEQ ID NO: 3015 - RNA, 59 nt, Human herpesvirus 1
gcucggaggugcgucucggccaggcgucggcgcagggccgcgugggcggcaucucgguc

SEQ ID NO: 3016 - RNA, 56 nt, Human herpesvirus 1
ggguuggccguggccgcgaaggcccgggacgggucgcucuggccguggucguacau

SEQ ID NO: 3017 - RNA, 102 nt, Human herpesvirus 1
cggcggugggcgaaaggggguccggggcaaggaggggcgcggggccgccggagucgucagacgcgagcuccuccaggccgugaauccaugcccacaugcgag

SEQ ID NO: 3018 - RNA, 58 nt, Human herpesvirus 1
agcacagccgcggucgucccgauaaugggguccugggggcgcagcggcagguuguggu

SEQ ID NO: 3019 - RNA, 56 nt, Human herpesvirus 1
gggggguccgcguucgucggaaaucgcgauuagcucgucuccgacguccaccucgc

SEQ ID NO: 3020 - RNA, 55 nt, Human herpesvirus 1
gguuguugaggcgguccgcguacacguugccguucgcgaggagccgcuggauaac

SEQ ID NO: 3021 - RNA, 58 nt, Human herpesvirus 1
uguacgagcaacccggggagguucucggccaagagcgccgucuccggaagcccguggg

SEQ ID NO: 3022 - RNA, 55 nt, Human herpesvirus 1
ggagcgcuuuccggacgcccggccgcgguacgagggcgagugggagaugcuacgc

SEQ ID NO: 3023 - RNA, 57 nt, Human herpesvirus 1
ugauguugguguugacgacggacaugaagccguguuggucccgcaagaccacguaag

SEQ ID NO: 3024 - RNA, 55 nt, Human herpesvirus 1
cgcggcgguggccggccgcgacgccacgggccgcuucacggccgggcagccccgg

SEQ ID NO: 3025 - RNA, 55 nt, Human herpesvirus 1
agaucgaggacuggcuggcgcuccuggaggacgaguaccuaagcgaggagaugau

SEQ ID NO: 3026 - RNA, 55 nt, Human herpesvirus 1
cgccgggauuuggggggggugcucggaugcgauuugagcucggcuccgaggcggg

SEQ ID NO: 3027 - RNA, 56 nt, Human herpesvirus 1
gggacugcaggagcuucagggaguggcgcagcugcuucauccccguggcccguugc

SEQ ID NO: 3028 - RNA, 59 nt, Human herpesvirus 1
cggccacgaacgacgggagcggcugcggagcacgcggaccgggagcgggagucgcagag

SEQ ID NO: 3029 - RNA, 57 nt, Human herpesvirus 1
gguuggggcuggggcuggggcuggggcuggggcuggggcuggggcuggggcuggggc

SEQ ID NO: 3030 - RNA, 57 nt, Human herpesvirus 1
ggcuggggccggggagggcuggggccggggagggcuggggccggggagggcuggggc

SEQ ID NO: 3031 - RNA, 57 nt, Human herpesvirus 1; identical to SEQ ID NO: 3030

SEQ ID NO: 3032 - RNA, 58 nt, Human herpesvirus 1
cgcgugaggccgcccgcggggacggccccggaagucuccgcguggcgcgucuuccggg

SEQ ID NO: 3033 - RNA, 58 nt, Human herpesvirus 1
ggaggcgggcgcggcggacagccgccccagggcggcgaggauccccgcggcgccguac

SEQ ID NO: 3034 - RNA, 58 nt, Human herpesvirus 1; identical to SEQ ID NO: 3033

SEQ ID NO: 3035 - RNA, 55 nt, Human herpesvirus 1
ggagcgggggaugccgcggcccccggguccugggggcgcccgcgcaccacgucuc

SEQ ID NO: 3036 - RNA, 84 nt, Human herpesvirus 1
cgacgacagaaacccaccgguccgccuuuuuugcacggguaagcaccuugggugggcggaggagggggggacgcggggguggag

SEQ ID NO: 3037 - RNA, 56 nt, Human herpesvirus 1
ggaggggguagggggcccggggccacacccgcccacagccgcccagucgccgccac

SEQ ID NO: 3038 - RNA, 59 nt, Human herpesvirus 1
cgaacccgagggugggggcgccaggcacacacaugaaccacacgcgacacgcgggaaag

SEQ ID NO: 3039 - RNA, 59 nt, Human herpesvirus 1
cgaacgcggccacgaagaugcuagcggcgcaguggggcgcccccaggcauuuggcacag

SEQ ID NO: 3040 - RNA, 56 nt, Human herpesvirus 1
agaccuguuuuucaagcgccugauucgccaccuggacggcgagaagaacgucacau

SEQ ID NO: 3041 - RNA, 61 nt, Human herpesvirus 1
ugccgcuuuaucccacggccucgccaguuucggucgaagccuacuacucggaaagcgaaga

SEQ ID NO: 3042 - RNA, 55 nt, Human herpesvirus 1
agcccaucaacaggaggucaguguccgugguguacacguacgcgaccguguuggu

SEQ ID NO: 3043 - RNA, 56 nt, Human herpesvirus 1
uggcggccgucccggggcuggccggggcccggcccgccagccccccgcggccggag

SEQ ID NO: 3044 - RNA, 56 nt, Human herpesvirus 1
cgggagagcggcggcccgcggcgcucgaaaaucgcagcgcuggcggccgucucgag

SEQ ID NO: 3045 - RNA, 57 nt, Human herpesvirus 1
cggacugaccuggccucuggccgccacaaagggcgggggggguuaacuacacuauag

SEQ ID NO: 3046 - RNA, 57 nt, Human herpesvirus 1
aggccccccgccguccuugcaucacggaccgucugcaagaggucgucgggggacggu

SEQ ID NO: 3047 - RNA, 58 nt, Human herpesvirus 1
ggggacggacccauggaguaacgccauaucuggaggcggaacuccaugcggguggaau

SEQ ID NO: 3048 - RNA, 56 nt, Human herpesvirus 1
cguccucgucgacaucguccgcggcauccgcgcuggggucguccucuaugggguag

SEQ ID NO: 3049 - RNA, 55 nt, Human herpesvirus 1
cugcgugcuggacguccgcgacgaacagggccgcgaugucugucagguacguuug

SEQ ID NO: 3050 - RNA, 59 nt, Human herpesvirus 1
guccgggugcgccaccugguggucugggccucggccgcccgccuggcgcgccgcggcuc

SEQ ID NO: 3051 - RNA, 59 nt, Human herpesvirus 1; identical to SEQ ID NO: 3050

SEQ ID NO: 3052 - RNA, 55 nt, Human herpesvirus 1
cucgugugguacaccgucuucggugccaguccgcugcaccgauguauuuacgcgg

SEQ ID NO: 3053 - RNA, 56 nt, Human herpesvirus 1
uucggggggcgaaccggccgccugucgcucgucagggccggcggcgcuccucgccg

SEQ ID NO: 3054 - RNA, 56 nt, Human herpesvirus 1
cucacgcugcaggugcuggcccacaacauggccgaacgcacaacggcgcugcucug

SEQ ID NO: 3055 - RNA, 56 nt, Human herpesvirus 1
gucgggguccacgcgggccgcgggaaacaggagcugaaccgcagccagagccccgc

SEQ ID NO: 3056 - RNA, 70 nt, Human herpesvirus 1
uuacgccuacgccccaaugcccacgcaagaugagguagguaacccccccgugggugugacguugcguuua

SEQ ID NO: 3057 - RNA, 66 nt, Human herpesvirus 1
guacuggcgcagggccggcacgccccccaagucuuccgacagguguaggacggccucgugguaguc

SEQ ID NO: 3058 - RNA, 55 nt, Human herpesvirus 1
uuuacccccccgccaguuucgugccgggccaccuggagcuggcccaggaaguacg

SEQ ID NO: 3059 - RNA, 57 nt, Human herpesvirus 1
cugccgccgcgggaggauguguuuucguggacucguuauugcacccccgacgaggug

SEQ ID NO: 3060 - RNA, 56 nt, Human herpesvirus 1
guguguuuuggggggggcccguuuucggcgucuggccgcuccuccccccgcuccuc

SEQ ID NO: 3061 - RNA, 64 nt, Human herpesvirus 1
guaaccacuccccugggguuccggguuaugcuaauugcuuuuuuggcggaacacacggccccuc

SEQ ID NO: 3062 - RNA, 64 nt, Human herpesvirus 1; identical to SEQ ID NO: 3061

SEQ ID NO: 3063 - RNA, 57 nt, Human herpesvirus 1
guacggcgccgcggggauccucgccgcccuggggcggcuguccgccgcgcccgccuc

SEQ ID NO: 3064 - RNA, 65 nt, Human herpesvirus 1
guacccguugcagcuguucaugccggauuuuagccgugucaucgcagagccguucaacgccaacc

SEQ ID NO: 3065 - RNA, 57 nt, Human herpesvirus 1
guacgagaagccaucgccuuccuuccaaaacgcgaggaggaugccgguuucgacauu

SEQ ID NO: 3066 - RNA, 55 nt, Human herpesvirus 1
cuauggcuccugcgacccgaaacugcuuccgucuucggccccgcgucuggccccg

SEQ ID NO: 3067 - RNA, 56 nt, Human herpesvirus 1
aucaucgccauggacgcaaccgccaacgcgcaguugguggacuuccugugcggucu

SEQ ID NO: 3068 - RNA, 56 nt, Human herpesvirus 1
uucuggcguuacugucggcacgcagcggcgauuccgacgucgccguggcgccccug

SEQ ID NO: 3069 - RNA, 60 nt, Human herpesvirus 1
guggcggccucaaguucgucggcgcggcgucgcguggcgccgaugaccuuucccagcucc

SEQ ID NO: 3070 - RNA, 57 nt, Human herpesvirus 1
guggacaggcucuggagcauccgcacgacugcggugauauuaccggagaccuucugc

SEQ ID NO: 3071 - RNA, 58 nt, Human herpesvirus 1
augaagccccccgcaucgguggccguagggccccccggaggcuuggggggcgguuuuu

SEQ ID NO: 3072 - RNA, 55 nt, Human herpesvirus 1
uuguugucugggucaccauacacagagagacaggcucgggugucccggaccgucg

SEQ ID NO: 3073 - RNA, 67 nt, Human herpesvirus 1
guuaaauagcggcguugucucggaggugcuucuguuuggcgcccccgaccucggacgccacaccauc

SEQ ID NO: 3074 - RNA, 62 nt, Human herpesvirus 1
cuucuugucgcuugcguaauauggggaccagccccaggcacgucagccagucgauauauuug

SEQ ID NO: 3075 - RNA, 61 nt, Human herpesvirus 1
cuuuggaaacuugccggucgccgugcuccugugagcuugcgucccuccccgguuuccuuug

SEQ ID NO: 3076 - RNA, 60 nt, Human herpesvirus 1
cuuucugggagaugccgugaaccgcgaacccgcgcucaugcuggaguacuuuugccggug

SEQ ID NO: 3077 - RNA, 56 nt, Human herpesvirus 1
guuuguucggggacaagcgcgcucgucugacguuugggcuacucgucccagaauuu

SEQ ID NO: 3078 - RNA, 22 nt, Hepatitis C virus
ugguggaguccaaguggcgagc

SEQ ID NO: 3079 - RNA, 22 nt, Hepatitis C virus
caaagcacauguggaauuucau

SEQ ID NO: 3080 - RNA, 22 nt, Hepatitis C virus
ucgacaugguggcgggggccca

SEQ ID NO: 3081 - RNA, 22 nt, Hepatitis C virus
ggccuugccuacuauuccaugg

SEQ ID NO: 3082 - RNA, 22 nt, Hepatitis C virus
ggcuaagcguagguuggccagg

SEQ ID NO: 3083 - RNA, 22 nt, Hepatitis C virus
uggccagcucuucagcuagcca

SEQ ID NO: 3084 - RNA, 22 nt, Hepatitis C virus
uggugcccuggucgucggaguc

SEQ ID NO: 3085 - RNA, 22 nt, Hepatitis C virus
cugcgucggcaugugggcccgg

SEQ ID NO: 3086 - RNA, 22 nt, Hepatitis C virus
ucuuugcugcgccaucacaaca

SEQ ID NO: 3087 - RNA, 19 nt, Hepatitis C virus
gcgggccugcggcagaaga

SEQ ID NO: 3088 - RNA, 22 nt, Hepatitis C virus
ccugcacgccuuccccggcgcc

SEQ ID NO: 3089 - RNA, 22 nt, Hepatitis C virus
cgcuguggcggguggcugcuga

SEQ ID NO: 3090 - RNA, 22 nt, Hepatitis C virus
uaccaugucacgaacgacugcu

SEQ ID NO: 3091 - RNA, 22 nt, Hepatitis C virus
ggcggcggacuugaucaugcau

SEQ ID NO: 3092 - RNA, 22 nt, Hepatitis C virus
ccgcccaacucgcuccccccag

SEQ ID NO: 3093 - RNA, 22 nt, Hepatitis C virus
cgcugguaucgcuggugcggcu

SEQ ID NO: 3094 - RNA, 22 nt, Hepatitis C virus
gcccccauuacguacuccaccu

SEQ ID NO: 3095 - RNA, 22 nt, Hepatitis C virus
gacggugguugcuccgggggcg

SEQ ID NO: 3096 - RNA, 22 nt, Hepatitis C virus
uccucgcagcucuggccgcaua

SEQ ID NO: 3097 - RNA, 22 nt, Hepatitis C virus
ugugguuaucguggguaggauc

SEQ ID NO: 3098 - RNA, 22 nt, Hepatitis C virus
cagggguggcuggcgcgcucgu

SEQ ID NO: 3099 - RNA, 22 nt, Hepatitis C virus
ugagcggcgaggcgcccucugc

SEQ ID NO: 3100 - RNA, 22 nt, Hepatitis C virus
gcccccauuacguacuccaccu

SEQ ID NO: 3101 - RNA, 22 nt, Hepatitis C virus
gacggugguugcuccgggggcg

SEQ ID NO: 3102 - RNA, 22 nt, Hepatitis C virus
gggucuggcauuauugaccuug

SEQ ID NO: 3103 - RNA, 20 nt, Hepatitis C virus
agguguuccucgcuaggcuc

SEQ ID NO: 3104 - RNA, 22 nt, Hepatitis C virus
ucaggagcaacuugaaaaagcc

SEQ ID NO: 3105 - RNA, 22 nt, Hepatitis C virus
ggggccuguuacuccauugagc

SEQ ID NO: 3106 - RNA, 22 nt, Hepatitis C virus
ugguugcuccgggggcgcuuac

SEQ ID NO: 3107 - RNA, 22 nt, Hepatitis C virus
ugagugccacucaacugacuca

SEQ ID NO: 3108 - RNA, 22 nt, Hepatitis C virus
ugcuaccauccccacuacgaca

SEQ ID NO: 3109 - RNA, 22 nt, Hepatitis C virus
uugcucguuggggcggcugcuc

SEQ ID NO: 3110 - RNA, 22 nt, Hepatitis C virus
uggcgcauggccgcugcuccug

SEQ ID NO: 3111 - RNA, 22 nt, Hepatitis C virus
acgagcuuacgccauggaccgg

SEQ ID NO: 3112 - RNA, 22 nt, Hepatitis C virus
ggaggacacugugacaccaauu

SEQ ID NO: 3113 - RNA, 21 nt, Hepatitis C virus
uggcaaagaaugagguuuucu

SEQ ID NO: 3114 - RNA, 22 nt, Hepatitis C virus
uggugcccuggucgucggaguc

SEQ ID NO: 3115 - RNA, 22 nt, Hepatitis C virus
cugcgucggcaugugggcccgg

SEQ ID NO: 3116 - RNA, 22 nt, Hepatitis C virus
ucgaggagguggcccugucgaa

SEQ ID NO: 3117 - RNA, 19 nt, Hepatitis C virus
gcaaagccauccccaucga

SEQ ID NO: 3118 - RNA, 22 nt, Hepatitis C virus
accccaaguccuguugucgugg

SEQ ID NO: 3119 - RNA, 22 nt, Hepatitis C virus
cuacguacagcuggggggagaa

SEQ ID NO: 3120 - RNA, 22 nt, Hepatitis C virus
aggacggcgugaacuaugcaac

SEQ ID NO: 3121 - RNA, 22 nt, Hepatitis C virus
ugcucuuuuucuaucuuccucu

SEQ ID NO: 3122 - RNA, 22 nt, Hepatitis C virus
ggcguccacagucaaggcuaaa

SEQ ID NO: 3123 - RNA, 20 nt, Hepatitis C virus
gaagccugccgccugacgcc

SEQ ID NO: 3124 - RNA, 22 nt, Hepatitis C virus
uccaggaucggucaccgugcca

SEQ ID NO: 3125 - RNA, 21 nt, Hepatitis C virus
uggcccugucgaacacuggag

SEQ ID NO: 3126 - RNA, 22 nt, Hepatitis C virus
agguguuccucgcuaggcuccu

SEQ ID NO: 3127 - RNA, 20 nt, Hepatitis C virus
accagagcugaggcgcacuu

SEQ ID NO: 3128 - RNA, 22 nt, Hepatitis C virus
gcuggcuacagcgggggagaca

SEQ ID NO: 3129 - RNA, 19 nt, Hepatitis C virus
ccgcugguucaugcugugc

SEQ ID NO: 3130 - RNA, 22 nt, Hepatitis C virus
ucgaucuaccccggccacgcgu

SEQ ID NO: 3131 - RNA, 22 nt, Hepatitis C virus
cauggccugggacaugaugaug

SEQ ID NO: 3132 - RNA, 22 nt, Hepatitis C virus
uacagguuuguaacuccggggg

SEQ ID NO: 3133 - RNA, 22 nt, Hepatitis C virus
cauguucgauuccucgguccug

SEQ ID NO: 3134 - RNA, 22 nt, Hepatitis C virus
ugcggaaagucgcuggggguca

SEQ ID NO: 3135 - RNA, 22 nt, Hepatitis C virus
ccuucaugagacugggcgcgcu

SEQ ID NO: 3136 - RNA, 22 nt, Hepatitis C virus
aggaggaugcggcgagccuacg

SEQ ID NO: 3137 - RNA, 22 nt, Hepatitis C virus
uaugacuagguacuccgccccc

SEQ ID NO: 3138 - RNA, 22 nt, Hepatitis C virus
uggaaacuacuaugcggucccc

SEQ ID NO: 3139 - RNA, 19 nt, Hepatitis C virus
ccguaccgcaaacauucca

SEQ ID NO: 3140 - RNA, 22 nt, Hepatitis C virus
ugguggaguccaaguggcgagc

SEQ ID NO: 3141 - RNA, 22 nt, Hepatitis C virus
caaagcacauguggaauuucau

SEQ ID NO: 3142 - RNA, 22 nt, Hepatitis C virus
uggcacuacccaccucaacaau

SEQ ID NO: 3143 - RNA, 21 nt, Hepatitis C virus
gucgcaggugugugguccagu

SEQ ID NO: 3144 - RNA, 22 nt, Hepatitis C virus
uuaugguggcuccaucuuagcc

SEQ ID NO: 3145 - RNA, 21 nt, Hepatitis C virus
aaagguccgugagccgcauga

SEQ ID NO: 3146 - RNA, 22 nt, Hepatitis C virus
uuugggacugggugugcacggu

SEQ ID NO: 3147 - RNA, 20 nt, Hepatitis C virus
agaccuggcuccaguccaag

SEQ ID NO: 3148 - RNA, 22 nt, Hepatitis C virus
ccugggccuaccugucuccgcc

SEQ ID NO: 3149 - RNA, 21 nt, Hepatitis C virus
agauacuccuggggccggccg

SEQ ID NO: 3150 - RNA, 22 nt, Hepatitis C virus
cgccugacgcccccacauucgg

SEQ ID NO: 3151 - RNA, 20 nt, Hepatitis C virus
uggcuauggggcaaaggacg

SEQ ID NO: 3152 - RNA, 22 nt, Hepatitis C virus
cggcguaggucgcguaauuugg

SEQ ID NO: 3153 - RNA, 20 nt, Hepatitis C virus
ccucacaugcggccucgccg

SEQ ID NO: 3154 - RNA, 22 nt, Hepatitis C virus
uacugucccagggggggagggc

SEQ ID NO: 3155 - RNA, 17 nt, Hepatitis C virus
ucuucaacugggcagua

SEQ ID NO: 3156 - RNA, 22 nt, Hepatitis C virus
ugagucaugcuccucuaugccc

SEQ ID NO: 3157 - RNA, 22 nt, Hepatitis C virus
ccgggggaccccgaucucagcg

SEQ ID NO: 3158 - RNA, 22 nt, Hepatitis C virus
ggagcucagcccgcugcugcuc

SEQ ID NO: 3159 - RNA, 22 nt, Hepatitis C virus
guggcagguucugcccugcucu

SEQ ID NO: 3160 - RNA, 22 nt, Hepatitis C virus
ucgccccgccggcaugcgacau

SEQ ID NO: 3161 - RNA, 22 nt, Hepatitis C virus
guucgaucuaccccggccacgc

SEQ ID NO: 3162 - RNA, 22 nt, Hepatitis C virus
uaccccugcacugucaacuucu

SEQ ID NO: 3163 - RNA, 22 nt, Hepatitis C virus
gauguauguggggggcguggag

SEQ ID NO: 3164 - RNA, 22 nt, Hepatitis C virus
ggucacccucacacaccccaua

SEQ ID NO: 3165 - RNA, 21 nt, Hepatitis C virus
uggcaugcaugucggccgacc

SEQ ID NO: 3166 - RNA, 22 nt, Hepatitis C virus
caagacgugcggggcccccccg

SEQ ID NO: 3167 - RNA, 22 nt, Hepatitis C virus
ggggggucggcaauaacaccuu

SEQ ID NO: 3168 - RNA, 22 nt, Hepatitis C virus
uuggacugucuaccauggugcu

SEQ ID NO: 3169 - RNA, 16 nt, Hepatitis C virus
ggcccaaaaggcccaa

SEQ ID NO: 3170 - RNA, 22 nt, Hepatitis C virus
uggcacuacccaccucaacaau

SEQ ID NO: 3171 - RNA, 20 nt, Hepatitis C virus
gucgcaggugugugguccag

SEQ ID NO: 3172 - RNA, 22 nt, Hepatitis C virus
ccaucuggaguucugggagagc

SEQ ID NO: 3173 - RNA, 22 nt, Hepatitis C virus
cucacccauauagaugcccacu

SEQ ID NO: 3174 - RNA, 22 nt, Hepatitis C virus
ggacccccggcguaggucgcgu

SEQ ID NO: 3175 - RNA, 22 nt, Hepatitis C virus
ugcggccucgccgaccucaugg

SEQ ID NO: 3176 - RNA, 22 nt, Hepatitis C virus
caggcuggucccuggggcggca

SEQ ID NO: 3177 - RNA, 15 nt, Hepatitis C virus
uggccgcugcuccug

SEQ ID NO: 3178 - RNA, 22 nt, Hepatitis C virus
uaccaugucacgaacgacugcu

SEQ ID NO: 3179 - RNA, 22 nt, Hepatitis C virus
ggcggcggacuugaucaugcau

SEQ ID NO: 3180 - RNA, 22 nt, Hepatitis C virus
uaacaccaaccgccgcccacag

SEQ ID NO: 3181 - RNA, 22 nt, Hepatitis C virus
cgggcgguggucagaucguugg

SEQ ID NO: 3182 - RNA, 22 nt, Hepatitis C virus
uggaccaagcggagacggcugg

SEQ ID NO: 3183 - RNA, 22 nt, Hepatitis C virus
ucgccaccgcuacgccuccagg

SEQ ID NO: 3184 - RNA, 22 nt, Hepatitis C virus
gccauggaccgggagauggcug

SEQ ID NO: 3185 - RNA, 20 nt, Hepatitis C virus
gcgguuuuugugggucuggc

SEQ ID NO: 3186 - RNA, 22 nt, Hepatitis C virus
gcguauguuggacugucuacca

SEQ ID NO: 3187 - RNA, 21 nt, Hepatitis C virus
ggcccaaaaggcccaaucgcc

SEQ ID NO: 3188 - RNA, 22 nt, Hepatitis C virus
cgagugcuaugacgcgggcugu

SEQ ID NO: 3189 - RNA, 21 nt, Hepatitis C virus
cucacccccgcugagaccucg

SEQ ID NO: 3190 - RNA, 22 nt, Hepatitis C virus
cauguuacuugaaagccucugc

SEQ ID NO: 3191 - RNA, 20 nt, Hepatitis C virus
aggacugcacgaugcucgug

SEQ ID NO: 3192 - RNA, 22 nt, Hepatitis C virus
ucagcgggauacaguacuuagc

SEQ ID NO: 3193 - RNA, 19 nt, Hepatitis C virus
ugccugggaaccccgcgau

SEQ ID NO: 3194 - RNA, 22 nt, Hepatitis C virus
uuaggauguauguggggggcgu

SEQ ID NO: 3195 - RNA, 22 nt, Hepatitis C virus
uuaaugcugcaugcaacuggac

SEQ ID NO: 3196 - RNA, 22 nt, Hepatitis C virus
ggcaaugagggcaugggguggg

SEQ ID NO: 3197 - RNA, 20 nt, Hepatitis C virus
ucaccccgcggcucccggcc

SEQ ID NO: 3198 - RNA, 22 nt, Hepatitis C virus
uggaccaagcggagacggcugg

SEQ ID NO: 3199 - RNA, 22 nt, Hepatitis C virus
ucgccaccgcuacgccuccagg

SEQ ID NO: 3200 - RNA, 22 nt, Hepatitis C virus
cccugcacgccuuccccggcgc

SEQ ID NO: 3201 - RNA, 22 nt, Hepatitis C virus
gcuguggcggguggcugcugag

SEQ ID NO: 3202 - RNA, 22 nt, Hepatitis C virus
uccaggugagaucaauagggug

SEQ ID NO: 3203 - RNA, 22 nt, Hepatitis C virus
uaccgcccuugcgagucuggag

SEQ ID NO: 3204 - RNA, 22 nt, Hepatitis C virus
gggcuucucauaugacacccgc

SEQ ID NO: 3205 - RNA, 16 nt, Hepatitis C virus
acugagaaugacaucc

SEQ ID NO: 3206 - RNA, 22 nt, Hepatitis C virus
uggccugggacaugaugaugaa

SEQ ID NO: 3207 - RNA, 20 nt, Hepatitis C virus
guagugucgcaguuacuccg

SEQ ID NO: 3208 - RNA, 22 nt, Hepatitis C virus
gaguuuaccuguugccgcgcag

SEQ ID NO: 3209 - RNA, 22 nt, Hepatitis C virus
ugcgcgcgaucaggaagacuuc

SEQ ID NO: 3210 - RNA, 22 nt, Hepatitis C virus
acaccuaggugcaugguugacu

SEQ ID NO: 3211 - RNA, 18 nt, Hepatitis C virus
gcacuaccccugcacugu

SEQ ID NO: 3212 - RNA, 22 nt, Hepatitis C virus
acaagaaccaggucgaggggga

SEQ ID NO: 3213 - RNA, 22 nt, Hepatitis C virus
ucuuuccuggcgaccugcguca

SEQ ID NO: 3214 - RNA, 22 nt, Hepatitis C virus
ccagcccgccuuaucguauucc

SEQ ID NO: 3215 - RNA, 22 nt, Hepatitis C virus
aguucguguaugcgagaagaug

SEQ ID NO: 3216 - RNA, 22 nt, Hepatitis C virus
agggggccgugcaguggaugaa

SEQ ID NO: 3217 - RNA, 22 nt, Hepatitis C virus
uucgcuucgcgggguaaccaug

SEQ ID NO: 3218 - RNA, 22 nt, Hepatitis C virus
gacguccggaaccuauccagca

SEQ ID NO: 3219 - RNA, 22 nt, Hepatitis C virus
ggaggacuugcuggaggacacu

SEQ ID NO: 3220 - RNA, 22 nt, Hepatitis C virus
ggccgaccuggaagucgucacc

SEQ ID NO: 3221 - RNA, 22 nt, Hepatitis C virus
uaggcggaguccucgcagcucu

SEQ ID NO: 3222 - RNA, 22 nt, Hepatitis C virus
ugucccagggggggagggccgc

SEQ ID NO: 3223 - RNA, 22 nt, Hepatitis C virus
gcaaauaccucuucaacugggc

SEQ ID NO: 3224 - RNA, 22 nt, Hepatitis C virus
ggaauugccaggacgaccgggu

SEQ ID NO: 3225 - RNA, 22 nt, Hepatitis C virus
cgcucaaugccuggagauuugg

SEQ ID NO: 3226 - RNA, 22 nt, Hepatitis C virus
ggagguggcccugucgaacacu

SEQ ID NO: 3227 - RNA, 20 nt, Hepatitis C virus
ucuacggcaaagccaucccc

SEQ ID NO: 3228 - RNA, 22 nt, Hepatitis C virus
ggaaggugcuaguggacauucu

SEQ ID NO: 3229 - RNA, 15 nt, Hepatitis C virus
gguggcuggcgcgcu

SEQ ID NO: 3230 - RNA, 22 nt, Hepatitis C virus
accaggucgagggggagguuca

SEQ ID NO: 3231 - RNA, 21 nt, Hepatitis C virus
ucuuuccuggcgaccugcguc

SEQ ID NO: 3232 - RNA, 22 nt, Hepatitis C virus
uaacuccucccgcugcugggua

SEQ ID NO: 3233 - RNA, 22 nt, Hepatitis C virus
cacgcucgcggccaggaaugcu

SEQ ID NO: 3234 - RNA, 22 nt, Hepatitis C virus
uguugcuuuuccuucuccuggc

SEQ ID NO: 3235 - RNA, 22 nt, Hepatitis C virus
cugcuuguggaugaugcugcug

SEQ ID NO: 3236 - RNA, 22 nt, Hepatitis C virus
ucgcagcucuggccgcauauug

SEQ ID NO: 3237 - RNA, 20 nt, Hepatitis C virus
agugugguuaucguggguag

SEQ ID NO: 3238 - RNA, 22 nt, Hepatitis C virus
gcccgcucaccacccagaacac

SEQ ID NO: 3239 - RNA, 16 nt, Hepatitis C virus
ggggguggguagccgc

SEQ ID NO: 3240 - RNA, 22 nt, Hepatitis C virus
uacuccauugagccacuugacc

SEQ ID NO: 3241 - RNA, 22 nt, Hepatitis C virus
auugaacgacuccauggucuua

SEQ ID NO: 3242 - RNA, 22 nt, Hepatitis C virus
ccgugccccaagacgcaguguc

SEQ ID NO: 3243 - RNA, 20 nt, Hepatitis C virus
uaggacuggcaggggcaggg

SEQ ID NO: 3244 - RNA, 22 nt, Hepatitis C virus
ugcuagccgaguaguguugggu

SEQ ID NO: 3245 - RNA, 21 nt, Hepatitis C virus
uugugguacugccugauaggg

SEQ ID NO: 3246 - RNA, 22 nt, Hepatitis C virus
ucuacgccguguuccggcucgu

SEQ ID NO: 3247 - RNA, 22 nt, Hepatitis C virus
ugggacugggugugcacggugu

SEQ ID NO: 3248 - RNA, 22 nt, Hepatitis C virus
uuccucgcuaggcuccuauggu

SEQ ID NO: 3249 - RNA, 15 nt, Hepatitis C virus
ccagagcugaggcgc

SEQ ID NO: 3250 - RNA, 22 nt, Hepatitis C virus
uggaaacuacuaugcggucccc

SEQ ID NO: 3251 - RNA, 22 nt, Hepatitis C virus
ccguaccgcaaacauuccaagu

SEQ ID NO: 3252 - RNA, 22 nt, Hepatitis C virus
ccuauccagcagggccaucaac

SEQ ID NO: 3253 - RNA, 21 nt, Hepatitis C virus
ugugggaggacuugcuggagg

SEQ ID NO: 3254 - RNA, 22 nt, Hepatitis C virus
ccuuccucguguucuucugugc

SEQ ID NO: 3255 - RNA, 22 nt, Hepatitis C virus
uacaucaagggcaggcuggucc

SEQ ID NO: 3256 - RNA, 22 nt, Hepatitis C virus
ccuucaccauugagacgacgac

SEQ ID NO: 3257 - RNA, 19 nt, Hepatitis C virus
agugucgcgcucgcagcgg

SEQ ID NO: 3258 - RNA, 22 nt, Hepatitis C virus
agagcacuagagugccggccgc

SEQ ID NO: 3259 - RNA, 22 nt, Hepatitis C virus
gcccaaggguacaaggugcuug

SEQ ID NO: 3260 - RNA, 22 nt, Hepatitis C virus
agugcccaugucagguuccagc

SEQ ID NO: 3261 - RNA, 22 nt, Hepatitis C virus
acggagguggauggggugcggu

SEQ ID NO: 3262 - RNA, 22 nt, Hepatitis C virus
ugagucaugcuccucuaugccc

SEQ ID NO: 3263 - RNA, 22 nt, Hepatitis C virus
ccgggggaccccgaucucagcg

SEQ ID NO: 3264 - RNA, 22 nt, Hepatitis C virus
acuugaucaugcauacucccgg

SEQ ID NO: 3265 - RNA, 21 nt, Hepatitis C virus
guucgggaggguaacuccucc

SEQ ID NO: 3266 - RNA, 22 nt, Hepatitis C virus
auccugggccuaccugucuccg

SEQ ID NO: 3267 - RNA, 21 nt, Hepatitis C virus
agauacuccuggggccggccg

SEQ ID NO: 3268 - RNA, 22 nt, Hepatitis C virus
ucaucgacaugguggcgggggc

SEQ ID NO: 3269 - RNA, 20 nt, Hepatitis C virus
gggccuugccuacuauucca

SEQ ID NO: 3270 - RNA, 22 nt, Hepatitis C virus
uccaaucccggcugcgucccag

SEQ ID NO: 3271 - RNA, 20 nt, Hepatitis C virus
cugguucguugcuggcuaca

SEQ ID NO: 3272 - RNA, 22 nt, Hepatitis C virus
cgcacuugcauguguggguucc

SEQ ID NO: 3273 - RNA, 20 nt, Hepatitis C virus
gaggccgcgaugccaucauc

SEQ ID NO: 3274 - RNA, 22 nt, Hepatitis C virus
cuugcgcccaucacggccuacu

SEQ ID NO: 3275 - RNA, 22 nt, Hepatitis C virus
gccuacuugguugcaucaucac

SEQ ID NO: 3276 - RNA, 22 nt, Hepatitis C virus
gagccugucgucuucucugaca

SEQ ID NO: 3277 - RNA, 22 nt, Hepatitis C virus
ccaagaucaucaccuggggggc

SEQ ID NO: 3278 - RNA, 22 nt, Hepatitis C virus
gccggcccgagggcagggccug

SEQ ID NO: 3279 - RNA, 22 nt, Hepatitis C virus
guauccuuggccccucuauggc

SEQ ID NO: 3280 - RNA, 22 nt, Hepatitis C virus
ugacgcccccacauucggccaa

SEQ ID NO: 3281 - RNA, 22 nt, Hepatitis C virus
uggcuauggggcaaaggacguc

SEQ ID NO: 3282 - RNA, 22 nt, Hepatitis C virus
uaccauccccacuacgacaaua

SEQ ID NO: 3283 - RNA, 20 nt, Hepatitis C virus
uuugcucguuggggcggcug

SEQ ID NO: 3284 - RNA, 22 nt, Hepatitis C virus
uaaacaccaauggcaguuggca

SEQ ID NO: 3285 - RNA, 22 nt, Hepatitis C virus
ccugaacugcaaugacucccuc

SEQ ID NO: 3286 - RNA, 22 nt, Hepatitis C virus
ucacaacgggggggcacgcugc

SEQ ID NO: 3287 - RNA, 22 nt, Hepatitis C virus
uucgcgggccucuuuacaccug

SEQ ID NO: 3288 - RNA, 22 nt, Hepatitis C virus
uuacuugaaagccucugccgcc

SEQ ID NO: 3289 - RNA, 20 nt, Hepatitis C virus
uccaggacugcacgaugcuc

SEQ ID NO: 3290 - RNA, 22 nt, Hepatitis C virus
cagcgacgggucuuggucuacc

SEQ ID NO: 3291 - RNA, 22 nt, Hepatitis C virus
gcuagugaggacgucgucugcu

SEQ ID NO: 3292 - RNA, 22 nt, Hepatitis C virus
uggaauccaaguggcggacccu

SEQ ID NO: 3293 - RNA, 22 nt, Hepatitis C virus
gcgaagcauauguggaauuuca

SEQ ID NO: 3294 - RNA, 22 nt, Hepatitis C virus
uggauaugguggcgggggccca

SEQ ID NO: 3295 - RNA, 22 nt, Hepatitis C virus
ggccuugccuacuauuccaugg

SEQ ID NO: 3296 - RNA, 22 nt, Hepatitis C virus
agauguuugggauuggauaugc

SEQ ID NO: 3297 - RNA, 22 nt, Hepatitis C virus
ccuggcuccaguccaagcuccu

SEQ ID NO: 3298 - RNA, 22 nt, Hepatitis C virus
ugacgcccccacauucggccag

SEQ ID NO: 3299 - RNA, 22 nt, Hepatitis C virus
uggcuauggggcaaaggacguc

SEQ ID NO: 3300 - RNA, 22 nt, Hepatitis C virus
ugcccccaucacguacuccacc

SEQ ID NO: 3301 - RNA, 22 nt, Hepatitis C virus
gacggugguugcucugggggcg

SEQ ID NO: 3302 - RNA, 22 nt, Hepatitis C virus
ugucacgaacgacugcuccaac

SEQ ID NO: 3303 - RNA, 22 nt, Hepatitis C virus
ugaggcagcggacaugaucaug

SEQ ID NO: 3304 - RNA, 22 nt, Hepatitis C virus
agccagcucgccuuaucguauu

SEQ ID NO: 3305 - RNA, 22 nt, Hepatitis C virus
uucgugugugcgagaaaauggc

SEQ ID NO: 3306 - RNA, 22 nt, Hepatitis C virus
uggcgcccuagucgucgggguc

SEQ ID NO: 3307 - RNA, 22 nt, Hepatitis C virus
gcgucggcacgugggcccaggg

SEQ ID NO: 3308 - RNA, 22 nt, Hepatitis C virus
ugcucugccccucggggcacgc

SEQ ID NO: 3309 - RNA, 22 nt, Hepatitis C virus
ugugcacccgagggguugcgaa

SEQ ID NO: 3310 - RNA, 22 nt, Hepatitis C virus
ggaguuuaccuguugccgcgca

SEQ ID NO: 3311 - RNA, 22 nt, Hepatitis C virus
ugcgcgcgacuaggaagacuuc

SEQ ID NO: 3312 - RNA, 22 nt, Hepatitis C virus
cggguugcugcaaacagccacc

SEQ ID NO: 3313 - RNA, 22 nt, Hepatitis C virus
uggaauccaaguggcggacccu

SEQ ID NO: 3314 - RNA, 22 nt, Hepatitis C virus
cggcccaaagggcccaaucacc

SEQ ID NO: 3315 - RNA, 22 nt, Hepatitis C virus
gaccaggaccucgucggcuggc

SEQ ID NO: 3316 - RNA, 22 nt, Hepatitis C virus
cgcuagcguccccacuacgacg

SEQ ID NO: 3317 - RNA, 22 nt, Hepatitis C virus
uugcucguuggggcggcugcuc

SEQ ID NO: 3318 - RNA, 22 nt, Hepatitis C virus
uaccccugcacugucaacuuua

SEQ ID NO: 3319 - RNA, 21 nt, Hepatitis C virus
ggauguacguggggggagugg

SEQ ID NO: 3320 - RNA, 22 nt, Hepatitis C virus
uccaggugagaucaauagggug

SEQ ID NO: 3321 - RNA, 22 nt, Hepatitis C virus
uaccgcccuugcgagucuggag

SEQ ID NO: 3322 - RNA, 22 nt, Hepatitis C virus
uugagucguacuccuccaugcc

SEQ ID NO: 3323 - RNA, 22 nt, Hepatitis C virus
ccgggggaucccgaucucagcg

SEQ ID NO: 3324 - RNA, 22 nt, Hepatitis C virus
uaagcuguuccucgcuaggcuc

SEQ ID NO: 3325 - RNA, 22 nt, Hepatitis C virus
accagggccgaggcacacuugc

SEQ ID NO: 3326 - RNA, 22 nt, Hepatitis C virus
cguggguacaagggagucuggc

SEQ ID NO: 3327 - RNA, 17 nt, Hepatitis C virus
caaaccaccugcccaug

SEQ ID NO: 3328 - RNA, 22 nt, Hepatitis C virus
cccugcacgcccuccccggcgc

SEQ ID NO: 3329 - RNA, 22 nt, Hepatitis C virus
gcuguggcggguggcugcugag

SEQ ID NO: 3330 - RNA, 22 nt, Hepatitis C virus
uggaccaagcggagacggcugg

SEQ ID NO: 3331 - RNA, 22 nt, Hepatitis C virus
ucgccaccgcuacgccuccggg

SEQ ID NO: 3332 - RNA, 22 nt, Hepatitis C virus
ucgaggagguggcucuguccag

SEQ ID NO: 3333 - RNA, 19 nt, Hepatitis C virus
gcaaagccauccccaucga

SEQ ID NO: 3334 - RNA, 22 nt, Hepatitis C virus
ugucacgaacgacugcuccaac

SEQ ID NO: 3335 - RNA, 22 nt, Hepatitis C virus
ugaggcagcggacaugaucaug

SEQ ID NO: 3336 - RNA, 22 nt, Hepatitis C virus
agcagggguggcaggcgcgcuc

SEQ ID NO: 3337 - RNA, 22 nt, Hepatitis C virus
ugagcggcgagaugcccuccac

SEQ ID NO: 3338 - RNA, 22 nt, Hepatitis C virus
ugaugagcucgccgcgaagcug

SEQ ID NO: 3339 - RNA, 21 nt, Hepatitis C virus
cucaaugcuguagcauauuac

SEQ ID NO: 3340 - RNA, 22 nt, Hepatitis C virus
acggcuaaagccuacgcugcac

SEQ ID NO: 3341 - RNA, 22 nt, Hepatitis C virus
ugcuguauaggcugggagccgu

SEQ ID NO: 3342 - RNA, 22 nt, Hepatitis C virus
agucuuaccaucacucagcugc

SEQ ID NO: 3343 - RNA, 21 nt, Hepatitis C virus
accaguggaucaacgaggacu

SEQ ID NO: 3344 - RNA, 22 nt, Hepatitis C virus
uugagucguacuccuccaugcc

SEQ ID NO: 3345 - RNA, 22 nt, Hepatitis C virus
ccgggggaucccgaucucagcg

SEQ ID NO: 3346 - RNA, 22 nt, Hepatitis C virus
ugguugcucugggggcgccuau

SEQ ID NO: 3347 - RNA, 22 nt, Hepatitis C virus
ugagugccacucaacugacucg

SEQ ID NO: 3348 - RNA, 22 nt, Hepatitis C virus
uuugggauuggauaugcacggu

SEQ ID NO: 3349 - RNA, 21 nt, Hepatitis C virus
agaccuggcuccaguccaagc

SEQ ID NO: 3350 - RNA, 22 nt, Hepatitis C virus
ggggugggggcccaucacuuac

SEQ ID NO: 3351 - RNA, 22 nt, Hepatitis C virus
uauuguuggcacuacgcacccc

SEQ ID NO: 3352 - RNA, 22 nt, Hepatitis C virus
gccaccgcuacgccuccgggau

SEQ ID NO: 3353 - RNA, 21 nt, Hepatitis C virus
uccaaacaucgaggagguggc

SEQ ID NO: 3354 - RNA, 22 nt, Hepatitis C virus
uauggcaaugagggcuuggggu

SEQ ID NO: 3355 - RNA, 22 nt, Hepatitis C virus
accccguggcucucggccuagu

SEQ ID NO: 3356 - RNA, 22 nt, Hepatitis C virus
uggcgcccuagucgucgggguc

SEQ ID NO: 3357 - RNA, 22 nt, Hepatitis C virus
gcgucggcacgugggcccaggg

SEQ ID NO: 3358 - RNA, 22 nt, Hepatitis C virus
uccaggugagaucaauagggug

SEQ ID NO: 3359 - RNA, 21 nt, Hepatitis C virus
uaccgcccuugcgagucugga

SEQ ID NO: 3360 - RNA, 22 nt, Hepatitis C virus
ggggccuguuacuccauugagc

SEQ ID NO: 3361 - RNA, 19 nt, Hepatitis C virus
ucaacgacuccauggccuu

SEQ ID NO: 3362 - RNA, 22 nt, Hepatitis C virus
uuugguggcuccaucuuagccc

SEQ ID NO: 3363 - RNA, 22 nt, Hepatitis C virus
agguccgugagccgcuugacug

SEQ ID NO: 3364 - RNA, 22 nt, Hepatitis C virus
uggauaugguggcgggggccca

SEQ ID NO: 3365 - RNA, 22 nt, Hepatitis C virus
ggccuugccuacuauuccaugg

SEQ ID NO: 3366 - RNA, 22 nt, Hepatitis C virus
uaagcuguuccucgcuaggcuc

SEQ ID NO: 3367 - RNA, 22 nt, Hepatitis C virus
accagggccgaggcacacuugc

SEQ ID NO: 3368 - RNA, 22 nt, Hepatitis C virus
ccuccagugguacacggguguc

SEQ ID NO: 3369 - RNA, 17 nt, Hepatitis C virus
uaccaccuccacggagg

SEQ ID NO: 3370 - RNA, 22 nt, Hepatitis C virus
ugcggaagguugcuggggguca

SEQ ID NO: 3371 - RNA, 22 nt, Hepatitis C virus
cucucaugaaguuggccgcacu

SEQ ID NO: 3372 - RNA, 22 nt, Hepatitis C virus
ggucgagggggagguccaagug

SEQ ID NO: 3373 - RNA, 22 nt, Hepatitis C virus
caacacaaucuuuccuggcgac

SEQ ID NO: 3374 - RNA, 22 nt, Hepatitis C virus
aaagugccguacuucgugcgcg

SEQ ID NO: 3375 - RNA, 22 nt, Hepatitis C virus
caugcaugcuggugcggaaggu

SEQ ID NO: 3376 - RNA, 22 nt, Hepatitis C virus
ggcugaccuggaggucgucacg

SEQ ID NO: 3377 - RNA, 20 nt, Hepatitis C virus
uaggcggaguccuagcagcu

SEQ ID NO: 3378 - RNA, 22 nt, Hepatitis C virus
cggcguaggucgcgcaauuugg

SEQ ID NO: 3379 - RNA, 20 nt, Hepatitis C virus
ccucacgugcggcuucgccg

SEQ ID NO: 3380 - RNA, 22 nt, Hepatitis C virus
gauccucucuagucuuaccauc

SEQ ID NO: 3381 - RNA, 17 nt, Hepatitis C virus
ggcuucaccaguggauc

SEQ ID NO: 3382 - RNA, 22 nt, Hepatitis C virus
ugcucugccccucggggcacgc

SEQ ID NO: 3383 - RNA, 22 nt, Hepatitis C virus
ugugcacccgagggguugcgaa

SEQ ID NO: 3384 - RNA, 22 nt, Hepatitis C virus
ucucaccccacugcgggacugg

SEQ ID NO: 3385 - RNA, 22 nt, Hepatitis C virus
gaccuugcgguggcaguugagc

SEQ ID NO: 3386 - RNA, 22 nt, Hepatitis C virus
uacggcuaaagccuacgcugca

SEQ ID NO: 3387 - RNA, 22 nt, Hepatitis C virus
cuguauaggcugggagccguuc

SEQ ID NO: 3388 - RNA, 22 nt, Hepatitis C virus
accccaagcccugucguggugg

SEQ ID NO: 3389 - RNA, 22 nt, Hepatitis C virus
ucccuacguacaguugggggga

SEQ ID NO: 3390 - RNA, 22 nt, Hepatitis C virus
uacagcagcccuagugguaucg

SEQ ID NO: 3391 - RNA, 22 nt, Hepatitis C virus
ucccacaagcugucguggauau

SEQ ID NO: 3392 - RNA, 22 nt, Hepatitis C virus
aaccuauccagcaaggccguua

SEQ ID NO: 3393 - RNA, 22 nt, Hepatitis C virus
gaaggacuugcuggaagacacu

SEQ ID NO: 3394 - RNA, 22 nt, Hepatitis C virus
cggguugcugcaaacagccacc

SEQ ID NO: 3395 - RNA, 22 nt, Hepatitis C virus
uggaauccaaguggcggacccu

SEQ ID NO: 3396 - RNA, 22 nt, Hepatitis C virus
gcugaccuggaggucgucacga

SEQ ID NO: 3397 - RNA, 20 nt, Hepatitis C virus
guaggcggaguccuagcagc

SEQ ID NO: 3398 - RNA, 22 nt, Hepatitis C virus
aggacggcgugaacuaugcaac

SEQ ID NO: 3399 - RNA, 21 nt, Hepatitis C virus
cgguugcuccuuuucuaucuu

SEQ ID NO: 3400 - RNA, 22 nt, Hepatitis C virus
cgaccagcugcgguaauacccu

SEQ ID NO: 3401 - RNA, 20 nt, Hepatitis C virus
aaggccgcugcggccugucg

SEQ ID NO: 3402 - RNA, 22 nt, Hepatitis C virus
ggacccccggcguaggucgcgc

SEQ ID NO: 3403 - RNA, 22 nt, Hepatitis C virus
ugcggcuucgccgaucucaugg

SEQ ID NO: 3404 - RNA, 22 nt, Hepatitis C virus
caggcuggucccuggggcggca

SEQ ID NO: 3405 - RNA, 19 nt, Hepatitis C virus
cguauggccgcuacuccug

SEQ ID NO: 3406 - RNA, 22 nt, Hepatitis C virus
cggcuaagcguaggcuggccag

SEQ ID NO: 3407 - RNA, 22 nt, Hepatitis C virus
gccagcucaucagcuagccagc

SEQ ID NO: 3408 - RNA, 22 nt, Hepatitis C virus
uccugaacccguccgucgccgc

SEQ ID NO: 3409 - RNA, 21 nt, Hepatitis C virus
ggggcguauaugucuaaggca

SEQ ID NO: 3410 - RNA, 22 nt, Hepatitis C virus
ggcguccacaguuaaggcuaaa

SEQ ID NO: 3411 - RNA, 22 nt, Hepatitis C virus
gaagccuguaagcugacgcccc

SEQ ID NO: 3412 - RNA, 22 nt, Hepatitis C virus
uggaccaagcggagacggcugg

SEQ ID NO: 3413 - RNA, 22 nt, Hepatitis C virus
ucgccaccgcuacgccuccggg

SEQ ID NO: 3414 - RNA, 22 nt, Hepatitis C virus
aaccuauccagcaaggccguua

SEQ ID NO: 3415 - RNA, 22 nt, Hepatitis C virus
gaaggacuugcuggaagacacu

SEQ ID NO: 3416 - RNA, 22 nt, Hepatitis C virus
cggaucuguuuuccucgucgcc

SEQ ID NO: 3417 - RNA, 22 nt, Hepatitis C virus
cacgagacaguacaggacugca

SEQ ID NO: 3418 - RNA, 22 nt, Hepatitis C virus
uggcacuacgcaccccggccgu

SEQ ID NO: 3419 - RNA, 20 nt, Hepatitis C virus
cggcgcagguguguggucca

SEQ ID NO: 3420 - RNA, 22 nt, Hepatitis C virus
caucgugcggaggcgcgguuuu

SEQ ID NO: 3421 - RNA, 20 nt, Hepatitis C virus
ccuugucaccgcacuauaag

SEQ ID NO: 3422 - RNA, 22 nt, Hepatitis C virus
gaacggggagcuaaacacucca

SEQ ID NO: 3423 - RNA, 20 nt, Hepatitis C virus
uccuguuuuuuucccuuuuu

SEQ ID NO: 3424 - RNA, 22 nt, Hepatitis C virus
uguguuggacugucuaucaugg

SEQ ID NO: 3425 - RNA, 22 nt, Hepatitis C virus
ggcccaaagggcccaaucaccc

SEQ ID NO: 3426 - RNA, 22 nt, Hepatitis C virus
ggaguuuaccuguugccgcgca

SEQ ID NO: 3427 - RNA, 22 nt, Hepatitis C virus
ugcgcgcgacuaggaagacuuc

SEQ ID NO: 3428 - RNA, 22 nt, Hepatitis C virus
ugucccagggggggagggcugc

SEQ ID NO: 3429 - RNA, 20 nt, Hepatitis C virus
guaccucuucaacugggcag

SEQ ID NO: 3430 - RNA, 22 nt, Hepatitis C virus
cccucccucaggccgugauggg

SEQ ID NO: 3431 - RNA, 22 nt, Hepatitis C virus
caauacucuccuggacagcggg

SEQ ID NO: 3432 - RNA, 22 nt, Hepatitis C virus
aauugccaggacgaccgggucc

SEQ ID NO: 3433 - RNA, 19 nt, Hepatitis C virus
cgcucaaugccuggagauu

SEQ ID NO: 3434 - RNA, 22 nt, Hepatitis C virus
ggaauugccaggacgaccgggu

SEQ ID NO: 3435 - RNA, 22 nt, Hepatitis C virus
cgcucaaugccuggagauuugg

SEQ ID NO: 3436 - RNA, 22 nt, Hepatitis C virus
ggagguggcucuguccagcacu

SEQ ID NO: 3437 - RNA, 20 nt, Hepatitis C virus
uuuauggcaaagccaucccc

SEQ ID NO: 3438 - RNA, 22 nt, Hepatitis C virus
uaccccugcacugucaacuuua

SEQ ID NO: 3439 - RNA, 21 nt, Hepatitis C virus
uuaggauguacguggggggag

SEQ ID NO: 3440 - RNA, 22 nt, Hepatitis C virus
ucaccauugagacgacgaccgu

SEQ ID NO: 3441 - RNA, 22 nt, Hepatitis C virus
ggugucacgcucgcagcggcga

SEQ ID NO: 3442 - RNA, 22 nt, Hepatitis C virus
uggaaaccacuaugcggucccc

SEQ ID NO: 3443 - RNA, 22 nt, Hepatitis C virus
cguaccgcagacauuccaggug

SEQ ID NO: 3444 - RNA, 22 nt, Hepatitis C virus
acacugagacaccaauugacac

SEQ ID NO: 3445 - RNA, 20 nt, Hepatitis C virus
aaaaaugagguuuucugcgu

SEQ ID NO: 3446 - RNA, 22 nt, Hepatitis C virus
ccacuacgugacgggcaugacc

SEQ ID NO: 3447 - RNA, 19 nt, Hepatitis C virus
ugcccgugucagguuccgg

SEQ ID NO: 3448 - RNA, 22 nt, Hepatitis C virus
agaucagagcuuagcccgcugc

SEQ ID NO: 3449 - RNA, 19 nt, Hepatitis C virus
gaguggcagguauugcccu

SEQ ID NO: 3450 - RNA, 22 nt, Hepatitis C virus
gcccaggggagggggcugugca

SEQ ID NO: 3451 - RNA, 22 nt, Hepatitis C virus
auagcguucgcuucgcggggua

SEQ ID NO: 3452 - RNA, 22 nt, Hepatitis C virus
cgcuacuccugcuccugcuggc

SEQ ID NO: 3453 - RNA, 22 nt, Hepatitis C virus
gccauggaccgggagauggcag

SEQ ID NO: 3454 - RNA, 22 nt, Hepatitis C virus
ggcacuacgcaccccggccgug

SEQ ID NO: 3455 - RNA, 20 nt, Hepatitis C virus
gcggcgcagguguguggucc

SEQ ID NO: 3456 - RNA, 22 nt, Hepatitis C virus
ucaggcuccaccuccaucgugg

SEQ ID NO: 3457 - RNA, 22 nt, Hepatitis C virus
uggaagugucucauacggcuaa

SEQ ID NO: 3458 - RNA, 22 nt, Hepatitis C virus
ugcccccaucacguacuccacc

SEQ ID NO: 3459 - RNA, 22 nt, Hepatitis C virus
gacggugguugcucugggggcg

SEQ ID NO: 3460 - RNA, 22 nt, Hepatitis C virus
uugugggcaaggaugauccuga

SEQ ID NO: 3461 - RNA, 16 nt, Hepatitis C virus
uccuucuagcucagga

SEQ ID NO: 3462 - RNA, 22 nt, Hepatitis C virus
uggccggggcgcauggcauucu

SEQ ID NO: 3463 - RNA, 20 nt, Hepatitis C virus
uucuucugugcugccuggua

SEQ ID NO: 3464 - RNA, 22 nt, Hepatitis C virus
ugcuagccgaguaguguugggu

SEQ ID NO: 3465 - RNA, 21 nt, Hepatitis C virus
uugugguacugccugauaggg

SEQ ID NO: 3466 - RNA, 22 nt, Hepatitis C virus
gaugaacggggagcuaaacacu

SEQ ID NO: 3467 - RNA, 22 nt, Hepatitis C virus
uuuuuuucccuuuuuuuuuuuc

SEQ ID NO: 3468 - RNA, 22 nt, Hepatitis C virus
ccgcuguuuugacucaacgguc

SEQ ID NO: 3469 - RNA, 22 nt, Hepatitis C virus
uguugaggagucaaucuaccaa

SEQ ID NO: 3470 - RNA, 22 nt, Hepatitis C virus
auugccgggaguccccuucuuc

SEQ ID NO: 3471 - RNA, 21 nt, Hepatitis C virus
uacaagggagucuggcggggc

SEQ ID NO: 3472 - RNA, 22 nt, Hepatitis C virus
accuuugacagacugcaggucc

SEQ ID NO: 3473 - RNA, 15 nt, Hepatitis C virus
gacgugcucaaggag

SEQ ID NO: 3474 - RNA, 22 nt, Hepatitis C virus
uaggaccuguaguaacacgugg

SEQ ID NO: 3475 - RNA, 16 nt, Hepatitis C virus
uaacgcguacaccacg

SEQ ID NO: 3476 - RNA, 22 nt, Hepatitis C virus
aaucccggcugcgucccaguug

SEQ ID NO: 3477 - RNA, 22 nt, Hepatitis C virus
cugguucguugcugguuacagc

SEQ ID NO: 3478 - RNA, 22 nt, Hepatitis C virus
augacuccccggacgcugaccu

SEQ ID NO: 3479 - RNA, 21 nt, Hepatitis C virus
uccuguggcggcaggagaugg

SEQ ID NO: 3480 - RNA, 22 nt, Hepatitis C virus
cucugggggcgccuaugacauc

SEQ ID NO: 3481 - RNA, 22 nt, Hepatitis C virus
ugugaugagugccacucaacug

SEQ ID NO: 3482 - RNA, 22 nt, Hepatitis C virus
caggaaccaggucgagggggag

SEQ ID NO: 3483 - RNA, 20 nt, Hepatitis C virus
uccaccgcaacacaaucuuu

SEQ ID NO: 3484 - RNA, 22 nt, Hepatitis C virus
ucaucccagaaaauccagcuug

SEQ ID NO: 3485 - RNA, 20 nt, Hepatitis C virus
cuggcacaucaacaggacug

SEQ ID NO: 3486 - RNA, 22 nt, Hepatitis C virus
cucgccggcacgagacaguaca

SEQ ID NO: 3487 - RNA, 22 nt, Hepatitis C virus
ugcucaauauaucccggccacg

SEQ ID NO: 3488 - RNA, 22 nt, Hepatitis C virus
ugcgagucuggagacaucgggc

SEQ ID NO: 3489 - RNA, 20 nt, Hepatitis C virus
ggcuacugucccaggggggg

SEQ ID NO: 3490 - RNA, 22 nt, Hepatitis C virus
uugcuccucccagcgcugcuuc

SEQ ID NO: 3491 - RNA, 20 nt, Hepatitis C virus
cggcaucgcuggagcggcug

SEQ ID NO: 3492 - RNA, 22 nt, Hepatitis C virus
uggugcccugguugucgggguc

SEQ ID NO: 3493 - RNA, 22 nt, Hepatitis C virus
gcgccggcacgugggcccagga

SEQ ID NO: 3494 - RNA, 22 nt, Hepatitis C virus
agcgacgggucuuggucuaccg

SEQ ID NO: 3495 - RNA, 22 nt, Hepatitis C virus
gcuagugaggacgucgucugcu

SEQ ID NO: 3496 - RNA, 22 nt, Hepatitis C virus
ugguggaguccaaguggcgcgc

SEQ ID NO: 3497 - RNA, 22 nt, Hepatitis C virus
cgaagcacauguggaauuucau

SEQ ID NO: 3498 - RNA, 22 nt, Hepatitis C virus
ugguggaguccaaguggcgcgc

SEQ ID NO: 3499 - RNA, 22 nt, Hepatitis C virus
cgaagcacauguggaauuucau

SEQ ID NO: 3500 - RNA, 22 nt, Hepatitis C virus
aagcaccccgaggcuacuuaca

SEQ ID NO: 3501 - RNA, 22 nt, Hepatitis C virus
ccuugguugacaccuaggugcu

SEQ ID NO: 3502 - RNA, 22 nt, Hepatitis C virus
cagggauagaucagaacucagc

SEQ ID NO: 3503 - RNA, 22 nt, Hepatitis C virus
gaguggcagauacugcccuguu

SEQ ID NO: 3504 - RNA, 22 nt, Hepatitis C virus
caccccgaggcuacuuacacaa

SEQ ID NO: 3505 - RNA, 20 nt, Hepatitis C virus
ccuugguugacaccuaggug

SEQ ID NO: 3506 - RNA, 22 nt, Hepatitis C virus
ggccaagcguagguuggccagg

SEQ ID NO: 3507 - RNA, 22 nt, Hepatitis C virus
uggccagcucuucagcuagcca

SEQ ID NO: 3508 - RNA, 22 nt, Hepatitis C virus
uccggugguacacgggugccca

SEQ ID NO: 3509 - RNA, 22 nt, Hepatitis C virus
gcacccccaauaccacccccac

SEQ ID NO: 3510 - RNA, 22 nt, Hepatitis C virus
agccagcucgccuuaucguauu

SEQ ID NO: 3511 - RNA, 22 nt, Hepatitis C virus
uucgugugugcgagaagauggc

SEQ ID NO: 3512 - RNA, 22 nt, Hepatitis C virus
ugacgcccccacacucggccaa

SEQ ID NO: 3513 - RNA, 22 nt, Hepatitis C virus
gcuauggggcaaaggacguccg

SEQ ID NO: 3514 - RNA, 22 nt, Hepatitis C virus
gcucccaucacguauuccaccu

SEQ ID NO: 3515 - RNA, 22 nt, Hepatitis C virus
gacggugguugcuccgggggug

SEQ ID NO: 3516 - RNA, 22 nt, Hepatitis C virus
gaggcgcaguuuuuguaggauu

SEQ ID NO: 3517 - RNA, 22 nt, Hepatitis C virus
cauacuauaaaguguuccucgc

SEQ ID NO: 3518 - RNA, 22 nt, Hepatitis C virus
ucaggagcagcuugaaaaagcc

SEQ ID NO: 3519 - RNA, 22 nt, Hepatitis C virus
ggggccuguuacuccauugagc

SEQ ID NO: 3520 - RNA, 22 nt, Hepatitis C virus
ggguggcuggcgcacucguagc

SEQ ID NO: 3521 - RNA, 22 nt, Hepatitis C virus
cggcgagaugcccuccaccgag

SEQ ID NO: 3522 - RNA, 22 nt, Hepatitis C virus
uggugcccugguugucgggguc

SEQ ID NO: 3523 - RNA, 22 nt, Hepatitis C virus
gcgccggcacgugggcccagga

SEQ ID NO: 3524 - RNA, 22 nt, Hepatitis C virus
acguugagucauacuccuccau

SEQ ID NO: 3525 - RNA, 22 nt, Hepatitis C virus
gggacccugaucuuagcgacgg

SEQ ID NO: 3526 - RNA, 22 nt, Hepatitis C virus
cagacccccggcguaggucgcg

SEQ ID NO: 3527 - RNA, 22 nt, Hepatitis C virus
ugcggcuucgccgaccucaugg

SEQ ID NO: 3528 - RNA, 22 nt, Hepatitis C virus
cagccuuaccaucacucagcug

SEQ ID NO: 3529 - RNA, 20 nt, Hepatitis C virus
caguggaucaaugaggacug

SEQ ID NO: 3530 - RNA, 22 nt, Hepatitis C virus
caucagcguccccacuacgaca

SEQ ID NO: 3531 - RNA, 22 nt, Hepatitis C virus
uugcucguugggacggcugcuu

SEQ ID NO: 3532 - RNA, 22 nt, Hepatitis C virus
uggaucaagcggagacggcugg

SEQ ID NO: 3533 - RNA, 22 nt, Hepatitis C virus
ucgccaccgcuacgccuccagg

SEQ ID NO: 3534 - RNA, 22 nt, Hepatitis C virus
ucuccaggugagaucaauaggg

SEQ ID NO: 3535 - RNA, 19 nt, Hepatitis C virus
acccuugcgagucuggaga

SEQ ID NO: 3536 - RNA, 22 nt, Hepatitis C virus
acguugagucauacuccuccau

SEQ ID NO: 3537 - RNA, 22 nt, Hepatitis C virus
gggacccugaucuuagcgacgg

SEQ ID NO: 3538 - RNA, 22 nt, Hepatitis C virus
cccugcacacccuccccggcgc

SEQ ID NO: 3539 - RNA, 22 nt, Hepatitis C virus
gcuguggcggguggcugcugag

SEQ ID NO: 3540 - RNA, 22 nt, Hepatitis C virus
agccuuaccaucacucagcugc

SEQ ID NO: 3541 - RNA, 21 nt, Hepatitis C virus
accaguggaucaaugaggacu

SEQ ID NO: 3542 - RNA, 22 nt, Hepatitis C virus
uuggacuguuuuccacggugcc

SEQ ID NO: 3543 - RNA, 16 nt, Hepatitis C virus
ggcccaaaagguccaa

SEQ ID NO: 3544 - RNA, 22 nt, Hepatitis C virus
ggaggacggcgugaauuaugca

SEQ ID NO: 3545 - RNA, 20 nt, Hepatitis C virus
uugcucuuucucuaucuucc

SEQ ID NO: 3546 - RNA, 22 nt, Hepatitis C virus
caucagcguccccacuacgaca

SEQ ID NO: 3547 - RNA, 22 nt, Hepatitis C virus
uugcucguugggacggcugcuu

SEQ ID NO: 3548 - RNA, 22 nt, Hepatitis C virus
gcccaggagagggggcugugca

SEQ ID NO: 3549 - RNA, 22 nt, Hepatitis C virus
auagcguucgcuucucggggua

SEQ ID NO: 3550 - RNA, 22 nt, Hepatitis C virus
aaguguuccucgcuaggcucau

SEQ ID NO: 3551 - RNA, 20 nt, Hepatitis C virus
accagagccgaggcgcacuu

SEQ ID NO: 3552 - RNA, 22 nt, Hepatitis C virus
uggaucaagcggagacggcugg

SEQ ID NO: 3553 - RNA, 22 nt, Hepatitis C virus
ucgccaccgcuacgccuccagg

SEQ ID NO: 3554 - RNA, 22 nt, Hepatitis C virus
gcugcgucaccacaauaugguc

SEQ ID NO: 3555 - RNA, 13 nt, Hepatitis C virus
gcaggccugcggc

SEQ ID NO: 3556 - RNA, 22 nt, Hepatitis C virus
uggugacgagggcauggggugg

SEQ ID NO: 3557 - RNA, 22 nt, Hepatitis C virus
accccguggcucucggccuaau

SEQ ID NO: 3558 - RNA, 22 nt, Hepatitis C virus
uccaggugagaucaauagggug

SEQ ID NO: 3559 - RNA, 17 nt, Hepatitis C virus
acccuugcgagucugga

SEQ ID NO: 3560 - RNA, 22 nt, Hepatitis C virus
uacagguuugugacuccagggg

SEQ ID NO: 3561 - RNA, 22 nt, Hepatitis C virus
cauguucgauuccucgguccug

SEQ ID NO: 3562 - RNA, 22 nt, Hepatitis C virus
ugcggaaagccgccggggguca

SEQ ID NO: 3563 - RNA, 22 nt, Hepatitis C virus
ccuucgugaagcuggccgcacu

SEQ ID NO: 3564 - RNA, 22 nt, Hepatitis C virus
caaacguaacaccaaccgccgc

SEQ ID NO: 3565 - RNA, 22 nt, Hepatitis C virus
gggcgguggucagaucguuggu

SEQ ID NO: 3566 - RNA, 22 nt, Hepatitis C virus
ggcugaccuggaggucgucacc

SEQ ID NO: 3567 - RNA, 20 nt, Hepatitis C virus
uaggcggaguccuugcagcu

SEQ ID NO: 3568 - RNA, 22 nt, Hepatitis C virus
aaaguguuccucgcuaggcuca

SEQ ID NO: 3569 - RNA, 22 nt, Hepatitis C virus
accagagccgaggcgcacuugc

SEQ ID NO: 3570 - RNA, 22 nt, Hepatitis C virus
cacggcuaaaaccuacacugca

SEQ ID NO: 3571 - RNA, 22 nt, Hepatitis C virus
cuguauaggcuaggagccgucc

SEQ ID NO: 3572 - RNA, 22 nt, Hepatitis C virus
uccgcaaggcaauugguucggc

SEQ ID NO: 3573 - RNA, 22 nt, Hepatitis C virus
ccggguucaccaagacgugugg

SEQ ID NO: 3574 - RNA, 22 nt, Hepatitis C virus
ugcuccgggggugccuacgaca

SEQ ID NO: 3575 - RNA, 22 nt, Hepatitis C virus
gagugccacucaacugacucga

SEQ ID NO: 3576 - RNA, 22 nt, Hepatitis C virus
uggcacuacccaccccgaccgu

SEQ ID NO: 3577 - RNA, 21 nt, Hepatitis C virus
guuggaggugugugguccagu

SEQ ID NO: 3578 - RNA, 22 nt, Hepatitis C virus
cauuucaaguggcucaucugca

SEQ ID NO: 3579 - RNA, 20 nt, Hepatitis C virus
gcggcaagagcacuaaagug

SEQ ID NO: 3580 - RNA, 22 nt, Hepatitis C virus
ggcgacuucgacucagugaucg

SEQ ID NO: 3581 - RNA, 22 nt, Hepatitis C virus
ucacucagacagucgacuucag

SEQ ID NO: 3582 - RNA, 22 nt, Hepatitis C virus
uggcacuacccaccccgaccgu

SEQ ID NO: 3583 - RNA, 22 nt, Hepatitis C virus
guuggaggugugugguccagug

SEQ ID NO: 3584 - RNA, 22 nt, Hepatitis C virus
ggcagcuccggaucgucggccg

SEQ ID NO: 3585 - RNA, 22 nt, Hepatitis C virus
gcacggcgacugccccuccuga

SEQ ID NO: 3586 - RNA, 22 nt, Hepatitis C virus
agaggaugcggcgagccuacga

SEQ ID NO: 3587 - RNA, 22 nt, Hepatitis C virus
uaugacuagguauucugccccc

SEQ ID NO: 3588 - RNA, 22 nt, Hepatitis C virus
uuuaccuguugccgcgcagggg

SEQ ID NO: 3589 - RNA, 21 nt, Hepatitis C virus
ugugcgcgcgacuaggaagac

SEQ ID NO: 3590 - RNA, 22 nt, Hepatitis C virus
accccaagcccuguuguggugg

SEQ ID NO: 3591 - RNA, 22 nt, Hepatitis C virus
ucccuaccuauagcugggggga

SEQ ID NO: 3592 - RNA, 22 nt, Hepatitis C virus
cacggcuaaaaccuacacugca

SEQ ID NO: 3593 - RNA, 22 nt, Hepatitis C virus
cuguauaggcuaggagccgucc

SEQ ID NO: 3594 - RNA, 22 nt, Hepatitis C virus
uggaagacacugagacaccaau

SEQ ID NO: 3595 - RNA, 18 nt, Hepatitis C virus
uuuucuguguccagccag

SEQ ID NO: 3596 - RNA, 22 nt, Hepatitis C virus
aaccuauccagcagggccguca

SEQ ID NO: 3597 - RNA, 22 nt, Hepatitis C virus
ggaggacuugcuggaagacacu

SEQ ID NO: 3598 - RNA, 22 nt, Hepatitis C virus
ugggacuggauaugcacgguau

SEQ ID NO: 3599 - RNA, 15 nt, Hepatitis C virus
ucaaguccaagcuca

SEQ ID NO: 3600 - RNA, 22 nt, Hepatitis C virus
ucccaucacguauuccaccuau

SEQ ID NO: 3601 - RNA, 20 nt, Hepatitis C virus
cgacggugguugcuccgggg

SEQ ID NO: 3602 - RNA, 22 nt, Hepatitis C virus
acucgcuccccccagcgcugcu

SEQ ID NO: 3603 - RNA, 22 nt, Hepatitis C virus
ccggcguugccggugcggcugu

SEQ ID NO: 3604 - RNA, 22 nt, Hepatitis C virus
cgugacagggggggugcaagcc

SEQ ID NO: 3605 - RNA, 22 nt, Hepatitis C virus
gcuugcaucccucuuuaacguu

SEQ ID NO: 3606 - RNA, 22 nt, Hepatitis C virus
accccaagcccuguuguggugg

SEQ ID NO: 3607 - RNA, 22 nt, Hepatitis C virus
ucccuaccuauagcugggggga

SEQ ID NO: 3608 - RNA, 22 nt, Hepatitis C virus
ccagguugagggggagguucaa

SEQ ID NO: 3609 - RNA, 22 nt, Hepatitis C virus
caaucuuuccuggcgaccugca

SEQ ID NO: 3610 - RNA, 22 nt, Hepatitis C virus
uaacaccaaccgccgcccacag

SEQ ID NO: 3611 - RNA, 22 nt, Hepatitis C virus
cgggcgguggucagaucguugg

SEQ ID NO: 3612 - RNA, 22 nt, Hepatitis C virus
ggcguaggucgcguaauuuggg

SEQ ID NO: 3613 - RNA, 20 nt, Hepatitis C virus
cccucacaugcggcuucgcc

SEQ ID NO: 3614 - RNA, 22 nt, Hepatitis C virus
cgacuagcugcgguaauacccu

SEQ ID NO: 3615 - RNA, 20 nt, Hepatitis C virus
aaagccucugcggccugucg

SEQ ID NO: 3616 - RNA, 22 nt, Hepatitis C virus
ucgguccugugugagugcuaug

SEQ ID NO: 3617 - RNA, 22 nt, Hepatitis C virus
guacgagcucacgcccgccgag

SEQ ID NO: 3618 - RNA, 22 nt, Hepatitis C virus
uccaauuccggcugcgucccgg

SEQ ID NO: 3619 - RNA, 22 nt, Hepatitis C virus
ugguucgucgccgguuacagcg

SEQ ID NO: 3620 - RNA, 22 nt, Hepatitis C virus
ugcaaacagccaccaagcaagc

SEQ ID NO: 3621 - RNA, 17 nt, Hepatitis C virus
gugguggaguccaagug

SEQ ID NO: 3622 - RNA, 22 nt, Hepatitis C virus
ucaugccgcaauuaccgggagu

SEQ ID NO: 3623 - RNA, 22 nt, Hepatitis C virus
ucuugccaacgcggcuacaagg

SEQ ID NO: 3624 - RNA, 22 nt, Hepatitis C virus
gaguuuaccuguugccgcgcag

SEQ ID NO: 3625 - RNA, 22 nt, Hepatitis C virus
ugcgcgcgacuaggaagacuuc

SEQ ID NO: 3626 - RNA, 22 nt, Hepatitis C virus
ucccacccuugcgagucuggag

SEQ ID NO: 3627 - RNA, 16 nt, Hepatitis C virus
ucccagggggggaggg

SEQ ID NO: 3628 - RNA, 22 nt, Hepatitis C virus
cgcuguuuugacucaacgguca

SEQ ID NO: 3629 - RNA, 22 nt, Hepatitis C virus
uguugaggagucaauuuaccaa

SEQ ID NO: 3630 - RNA, 22 nt, Hepatitis C virus
aggcguccacaguuaaggcuaa

SEQ ID NO: 3631 - RNA, 22 nt, Hepatitis C virus
gaagccugcaaacugacgcccc

SEQ ID NO: 3632 - RNA, 22 nt, Hepatitis C virus
acugcaaugacacccuccagac

SEQ ID NO: 3633 - RNA, 20 nt, Hepatitis C virus
gcuguucuacaaacacaggu

SEQ ID NO: 3634 - RNA, 22 nt, Hepatitis C virus
ugucccagggggggagggccgc

SEQ ID NO: 3635 - RNA, 20 nt, Hepatitis C virus
guaccucuucaacugggcag

SEQ ID NO: 3636 - RNA, 22 nt, Hepatitis C virus
ggaauugccaggacgaccgggu

SEQ ID NO: 3637 - RNA, 22 nt, Hepatitis C virus
cgcucaaugccuggagauuugg

SEQ ID NO: 3638 - RNA, 22 nt, Hepatitis C virus
ucuugccccacugcaacauugg

SEQ ID NO: 3639 - RNA, 22 nt, Hepatitis C virus
uacgagaccuugcgguggcagu

SEQ ID NO: 3640 - RNA, 22 nt, Hepatitis C virus
ggcuucgccgaccucauggggu

SEQ ID NO: 3641 - RNA, 19 nt, Hepatitis C virus
cccucuaggaggcguugcc

SEQ ID NO: 3642 - RNA, 22 nt, Hepatitis C virus
ucuucgggugguccgcugcucu

SEQ ID NO: 3643 - RNA, 21 nt, Hepatitis C virus
augccgugggcaucuuccggg

SEQ ID NO: 3644 - RNA, 22 nt, Hepatitis C virus
uuaugggcaaggaugauucuga

SEQ ID NO: 3645 - RNA, 16 nt, Hepatitis C virus
uccuucuagcucagga

SEQ ID NO: 3646 - RNA, 22 nt, Hepatitis C virus
auaugcacgguauuggcugacu

SEQ ID NO: 3647 - RNA, 22 nt, Hepatitis C virus
uccaagcucaugccgcaauuac

SEQ ID NO: 3648 - RNA, 22 nt, Hepatitis C virus
ccaccgaggaccuggucaauuu

SEQ ID NO: 3649 - RNA, 17 nt, Hepatitis C virus
ugcccugguugucgggg

SEQ ID NO: 3650 - RNA, 22 nt, Hepatitis C virus
acgggccccugcacacccuccc

SEQ ID NO: 3651 - RNA, 22 nt, Hepatitis C virus
gcuguggcggguggcugcugag

SEQ ID NO: 3652 - RNA, 22 nt, Hepatitis C virus
ggaaggugcuuguggacauccu

SEQ ID NO: 3653 - RNA, 15 nt, Hepatitis C virus
gguggcuggcgcacu

SEQ ID NO: 3654 - RNA, 22 nt, Hepatitis C virus
ccagguugagggggagguucaa

SEQ ID NO: 3655 - RNA, 22 nt, Hepatitis C virus
caaucuuuccuggcgaccugca

SEQ ID NO: 3656 - RNA, 22 nt, Hepatitis C virus
ggaccaucuggaguucugggag

SEQ ID NO: 3657 - RNA, 20 nt, Hepatitis C virus
ccucacccauauagaugccc

SEQ ID NO: 3658 - RNA, 22 nt, Hepatitis C virus
uacgagcucacgcccgccgaga

SEQ ID NO: 3659 - RNA, 21 nt, Hepatitis C virus
ugcgggcguaccuaaauacac

SEQ ID NO: 3660 - RNA, 22 nt, Hepatitis C virus
ggaugcggcgagccuacgaguc

SEQ ID NO: 3661 - RNA, 22 nt, Hepatitis C virus
cuaugacuagguauucugcccc

SEQ ID NO: 3662 - RNA, 22 nt, Hepatitis C virus
cgcugcuucugcuccuguuggc

SEQ ID NO: 3663 - RNA, 22 nt, Hepatitis C virus
gccauggaccgggagauggcug

SEQ ID NO: 3664 - RNA, 22 nt, Hepatitis C virus
ugcggaaagccgccggggguca

SEQ ID NO: 3665 - RNA, 22 nt, Hepatitis C virus
ccuucgugaagcuggccgcacu

SEQ ID NO: 3666 - RNA, 22 nt, Hepatitis C virus
uccauggucuuagcgcauuuuc

SEQ ID NO: 3667 - RNA, 21 nt, Hepatitis C virus
ucuccaggugagaucaauagg

SEQ ID NO: 3668 - RNA, 22 nt, Hepatitis C virus
ugcuuaguugacuaccccuaua

SEQ ID NO: 3669 - RNA, 21 nt, Hepatitis C virus
accccugcacugucaacuuua

SEQ ID NO: 3670 - RNA, 22 nt, Hepatitis C virus
ugcuagccgaguaguguugggu

SEQ ID NO: 3671 - RNA, 21 nt, Hepatitis C virus
uugugguacugccugauaggg

SEQ ID NO: 3672 - RNA, 22 nt, Hepatitis C virus
uaccgggaguucgaugagaugg

SEQ ID NO: 3673 - RNA, 22 nt, Hepatitis C virus
ucccuuacaucgaacagggaau

SEQ ID NO: 3674 - RNA, 22 nt, Hepatitis C virus
uggauaugguggcgggggccca

SEQ ID NO: 3675 - RNA, 22 nt, Hepatitis C virus
ggccuugccuacuauuccaugg

SEQ ID NO: 3676 - RNA, 22 nt, Hepatitis C virus
uugcagcucuggccgcguauug

SEQ ID NO: 3677 - RNA, 20 nt, Hepatitis C virus
agcguagucauugugggcag

SEQ ID NO: 3678 - RNA, 22 nt, Hepatitis C virus
ugucacgaacgacugcuccaac

SEQ ID NO: 3679 - RNA, 22 nt, Hepatitis C virus
uaugaggcagcggacaucauca

SEQ ID NO: 3680 - RNA, 22 nt, Hepatitis C virus
uggauaugguggcgggggccca

SEQ ID NO: 3681 - RNA, 22 nt, Hepatitis C virus
ggccuugccuacuauuccaugg

SEQ ID NO: 3682 - RNA, 22 nt, Hepatitis C virus
uuuuccucgucucccagcuguu

SEQ ID NO: 3683 - RNA, 10 nt, Hepatitis C virus
gaaacaguac

SEQ ID NO: 3684 - RNA, 22 nt, Hepatitis C virus
auagaucagaacucagcccgcu

SEQ ID NO: 3685 - RNA, 19 nt, Hepatitis C virus
acagaguggcagauacugc

SEQ ID NO: 3686 - RNA, 22 nt, Hepatitis C virus
aauuucaucagcgggauacagu

SEQ ID NO: 3687 - RNA, 22 nt, Hepatitis C virus
uauccacucugccugggaaccc

SEQ ID NO: 3688 - RNA, 22 nt, Hepatitis C virus
aauuccggcugcgucccgguug

SEQ ID NO: 3689 - RNA, 22 nt, Hepatitis C virus
cugguucgucgccgguuacagc

SEQ ID NO: 3690 - RNA, 22 nt, Hepatitis C virus
uacgcuccggcguguaaaccuc

SEQ ID NO: 3691 - RNA, 22 nt, Hepatitis C virus
ggucacauuccaggucgggcuc

SEQ ID NO: 3692 - RNA, 22 nt, Hepatitis C virus
cauugacaaguucgcucaggga

SEQ ID NO: 3693 - RNA, 22 nt, Hepatitis C virus
uuaugcugagccugacaggcug

SEQ ID NO: 3694 - RNA, 22 nt, Hepatitis C virus
caccccaauaucgaggaggugg

SEQ ID NO: 3695 - RNA, 13 nt, Hepatitis C virus
gauccccuucuau

SEQ ID NO: 3696 - RNA, 22 nt, Hepatitis C virus
cagaacugcgguuaucgccggu

SEQ ID NO: 3697 - RNA, 22 nt, Hepatitis C virus
ugacgacuagcugcgguaauac

SEQ ID NO: 3698 - RNA, 22 nt, Hepatitis C virus
ccagccgauagucuugaggggc

SEQ ID NO: 3699 - RNA, 22 nt, Hepatitis C virus
cucgcgcccaucacggcuuacu

SEQ ID NO: 3700 - RNA, 22 nt, Hepatitis C virus
cugacagaguccaccgugucuu

SEQ ID NO: 3701 - RNA, 20 nt, Hepatitis C virus
gcucgcuacuaagaccuucg

SEQ ID NO: 3702 - RNA, 22 nt, Hepatitis C virus
ucuaaggcauaugguaccgacc

SEQ ID NO: 3703 - RNA, 16 nt, Hepatitis C virus
guaaggaccaucacca

SEQ ID NO: 3704 - RNA, 22 nt, Hepatitis C virus
uacugucccagggggggagggc

SEQ ID NO: 3705 - RNA, 22 nt, Hepatitis C virus
uaccucuucaacugggcaguaa

SEQ ID NO: 3706 - RNA, 22 nt, Hepatitis C virus
uugccgccacgugcuuacgcca

SEQ ID NO: 3707 - RNA, 21 nt, Hepatitis C virus
cugcaucauguggaggcgcag

SEQ ID NO: 3708 - RNA, 22 nt, Hepatitis C virus
uuacuccauugagccacuugac

SEQ ID NO: 3709 - RNA, 16 nt, Hepatitis C virus
gcggcuccauggucuu

SEQ ID NO: 3710 - RNA, 22 nt, Hepatitis C virus
uucuaucuaucccggccauaua

SEQ ID NO: 3711 - RNA, 22 nt, Hepatitis C virus
uggcaugggauaugaugaugaa

SEQ ID NO: 3712 - RNA, 22 nt, Hepatitis C virus
uacagcgggggagacauuuauc

SEQ ID NO: 3713 - RNA, 22 nt, Hepatitis C virus
ucucaugcccggccccgcuggu

SEQ ID NO: 3714 - RNA, 22 nt, Hepatitis C virus
uccacgaguacccggugggguc

SEQ ID NO: 3715 - RNA, 22 nt, Hepatitis C virus
agcccgaaccggacguagccgu

SEQ ID NO: 3716 - RNA, 22 nt, Hepatitis C virus
uuugggagggcgucuuuacggg

SEQ ID NO: 3717 - RNA, 22 nt, Hepatitis C virus
ucauauagaugcccacuuucua

SEQ ID NO: 3718 - RNA, 22 nt, Hepatitis C virus
gagcaccaaggucccggcugcg

SEQ ID NO: 3719 - RNA, 22 nt, Hepatitis C virus
agcccagggcuacaagguguug

SEQ ID NO: 3720 - RNA, 22 nt, Hepatitis C virus
uccuggcugcucuggccgcgua

SEQ ID NO: 3721 - RNA, 22 nt, Hepatitis C virus
cguggucauagugggcaggauu

SEQ ID NO: 3722 - RNA, 22 nt, Hepatitis C virus
cgcggggcgaacgcugugaucu

SEQ ID NO: 3723 - RNA, 22 nt, Hepatitis C virus
guccgagcucagcccauugcug

SEQ ID NO: 3724 - RNA, 22 nt, Hepatitis C virus
uucuguccagaggaggcagggc

SEQ ID NO: 3725 - RNA, 22 nt, Hepatitis C virus
uaccucuucaacugggcaguaa

SEQ ID NO: 3726 - RNA, 22 nt, Hepatitis C virus
acccaaggguccugucauccag

SEQ ID NO: 3727 - RNA, 19 nt, Hepatitis C virus
gaccaagaccuugugggcu

SEQ ID NO: 3728 - RNA, 22 nt, Hepatitis C virus
uggagcccuuguagucggugug

SEQ ID NO: 3729 - RNA, 22 nt, Hepatitis C virus
cugcgccggcacguuggcccgg

SEQ ID NO: 3730 - RNA, 22 nt, Hepatitis C virus
aaaacugcggcuaccgcaggug

SEQ ID NO: 3731 - RNA, 22 nt, Hepatitis C virus
cugacaacuagcugugguaaca

SEQ ID NO: 3732 - RNA, 22 nt, Hepatitis C virus
ucaaggcccgggcagccugucg

SEQ ID NO: 3733 - RNA, 22 nt, Hepatitis C virus
aggacugcaccaugcucgugug

SEQ ID NO: 3734 - RNA, 22 nt, Hepatitis C virus
uccaggugaaaucaauagggug

SEQ ID NO: 3735 - RNA, 22 nt, Hepatitis C virus
ucccgcccuugcgagcuuggag

SEQ ID NO: 3736 - RNA, 22 nt, Hepatitis C virus
ugccccgcgggacacgccgugg

SEQ ID NO: 3737 - RNA, 22 nt, Hepatitis C virus
cggugugcacccguggaguggc

SEQ ID NO: 3738 - RNA, 22 nt, Hepatitis C virus
cgguaagagcaccaaggucccg

SEQ ID NO: 3739 - RNA, 22 nt, Hepatitis C virus
gggcuacaagguguuggugcuc

SEQ ID NO: 3740 - RNA, 22 nt, Hepatitis C virus
aggaggacgcggcgagccugag

SEQ ID NO: 3741 - RNA, 22 nt, Hepatitis C virus
ccagguacuccgccccccccgg

SEQ ID NO: 3742 - RNA, 22 nt, Hepatitis C virus
ucguaugauacccgcuguuuug

SEQ ID NO: 3743 - RNA, 21 nt, Hepatitis C virus
gagagcgacauccguacggag

SEQ ID NO: 3744 - RNA, 22 nt, Hepatitis C virus
ggauuccaauacucaccaggac

SEQ ID NO: 3745 - RNA, 21 nt, Hepatitis C virus
cucgugcaagcguggaagucc

SEQ ID NO: 3746 - RNA, 22 nt, Hepatitis C virus
gagacugggcgcacaacggccu

SEQ ID NO: 3747 - RNA, 22 nt, Hepatitis C virus
ccguggcuguggaaccagucgu

SEQ ID NO: 3748 - RNA, 22 nt, Hepatitis C virus
aacgccccuacugcuggcacua

SEQ ID NO: 3749 - RNA, 22 nt, Hepatitis C virus
gcauugugcccgcaaagagcgu

SEQ ID NO: 3750 - RNA, 22 nt, Hepatitis C virus
gaguuuacuuguugccgcgcag

SEQ ID NO: 3751 - RNA, 22 nt, Hepatitis C virus
ugcgcgcgacgaggaagacuuc

SEQ ID NO: 3752 - RNA, 22 nt, Hepatitis C virus
uggagaaccuagagacaaccau

SEQ ID NO: 3753 - RNA, 21 nt, Hepatitis C virus
ucacggacaacuccucuccac

SEQ ID NO: 3754 - RNA, 22 nt, Hepatitis C virus
ugccccgcgggacacgccgugg

SEQ ID NO: 3755 - RNA, 22 nt, Hepatitis C virus
cggugugcacccguggaguggc

SEQ ID NO: 3756 - RNA, 22 nt, Hepatitis C virus
uccugcacacuccggggugugu

SEQ ID NO: 3757 - RNA, 22 nt, Hepatitis C virus
guaacgccucgagguguugggu

SEQ ID NO: 3758 - RNA, 22 nt, Hepatitis C virus
cguucaaggccuucuccggauc

SEQ ID NO: 3759 - RNA, 22 nt, Hepatitis C virus
gaagauagccggaggucauuac

SEQ ID NO: 3760 - RNA, 22 nt, Hepatitis C virus
uaagccagcucgucucaucgug

SEQ ID NO: 3761 - RNA, 22 nt, Hepatitis C virus
cgugugcgagaagauggcccug

SEQ ID NO: 3762 - RNA, 22 nt, Hepatitis C virus
uugaguccuauucuuccaugcc

SEQ ID NO: 3763 - RNA, 22 nt, Hepatitis C virus
ccuggggauccggaucucagcg

SEQ ID NO: 3764 - RNA, 22 nt, Hepatitis C virus
ggccucagcgcauuuucacucc

SEQ ID NO: 3765 - RNA, 19 nt, Hepatitis C virus
ugaaaucaauaggguggcc

SEQ ID NO: 3766 - RNA, 22 nt, Hepatitis C virus
ggaagacggcgugaacuaugca

SEQ ID NO: 3767 - RNA, 20 nt, Hepatitis C virus
uugcucuuucucuaucuucc

SEQ ID NO: 3768 - RNA, 22 nt, Hepatitis C virus
cagcggcgucaaaagugaaggc

SEQ ID NO: 3769 - RNA, 22 nt, Hepatitis C virus
cuugcagccugacgcccccaca

SEQ ID NO: 3770 - RNA, 22 nt, Hepatitis C virus
ucggcagcguuggacuggggaa

SEQ ID NO: 3771 - RNA, 22 nt, Hepatitis C virus
ucuugcaggguauggcgcgggc

SEQ ID NO: 3772 - RNA, 22 nt, Hepatitis C virus
cccgggcgagggggcagugcaa

SEQ ID NO: 3773 - RNA, 18 nt, Hepatitis C virus
uagccuucgccucccggg

SEQ ID NO: 3774 - RNA, 22 nt, Hepatitis C virus
uacuuguacgggguagggucaa

SEQ ID NO: 3775 - RNA, 21 nt, Hepatitis C virus
ugggccauuaagugggaguac

SEQ ID NO: 3776 - RNA, 22 nt, Hepatitis C virus
uugugucaucggaggggugggc

SEQ ID NO: 3777 - RNA, 22 nt, Hepatitis C virus
ugccccacugauuguuuccgca

SEQ ID NO: 3778 - RNA, 22 nt, Hepatitis C virus
uauggcaaugaggguugcgggu

SEQ ID NO: 3779 - RNA, 22 nt, Hepatitis C virus
cuccccguggcucucggccuag

SEQ ID NO: 3780 - RNA, 22 nt, Hepatitis C virus
aggaggacgcggcgagccugag

SEQ ID NO: 3781 - RNA, 22 nt, Hepatitis C virus
ccagguacuccgccccccccgg

SEQ ID NO: 3782 - RNA, 22 nt, Hepatitis C virus
caaacguaacaccaaccgucgc

SEQ ID NO: 3783 - RNA, 22 nt, Hepatitis C virus
ggguggcggucagaucguuggu

SEQ ID NO: 3784 - RNA, 22 nt, Hepatitis C virus
agcucccccuggccgugauggg

SEQ ID NO: 3785 - RNA, 22 nt, Hepatitis C virus
caauacucaccaggacagcggg

SEQ ID NO: 3786 - RNA, 22 nt, Hepatitis C virus
gcaggaacauguggagugggac

SEQ ID NO: 3787 - RNA, 20 nt, Hepatitis C virus
ccuacaccacgggccccugu

SEQ ID NO: 3788 - RNA, 22 nt, Hepatitis C virus
uaccacuccaugcuccgguucc

SEQ ID NO: 3789 - RNA, 19 nt, Hepatitis C virus
gacuggauaugcgaggugc

SEQ ID NO: 3790 - RNA, 22 nt, Hepatitis C virus
acggcaaacuccccacaacgca

SEQ ID NO: 3791 - RNA, 22 nt, Hepatitis C virus
cugcuugucgggagcgccaccc

SEQ ID NO: 3792 - RNA, 22 nt, Hepatitis C virus
ccgcuaccgccuuugugggcgc

SEQ ID NO: 3793 - RNA, 20 nt, Hepatitis C virus
gccgccaucggcagcguugg

SEQ ID NO: 3794 - RNA, 22 nt, Hepatitis C virus
cggccgggagaagguuggcgag

SEQ ID NO: 3795 - RNA, 22 nt, Hepatitis C virus
uauggccagcuccucggccagc

SEQ ID NO: 3796 - RNA, 22 nt, Hepatitis C virus
ucguguggcggcguuguucuug

SEQ ID NO: 3797 - RNA, 22 nt, Hepatitis C virus
ugacucugucgccauauuacaa

SEQ ID NO: 3798 - RNA, 22 nt, Hepatitis C virus
uccuggcugcucuggccgcgua

SEQ ID NO: 3799 - RNA, 20 nt, Hepatitis C virus
cguggucauagugggcagga

SEQ ID NO: 3800 - RNA, 22 nt, Hepatitis C virus
uccacgaguacccggugggguc

SEQ ID NO: 3801 - RNA, 22 nt, Hepatitis C virus
agcccgaaccggacguagccgu

SEQ ID NO: 3802 - RNA, 22 nt, Hepatitis C virus
caauguggaccaagaccuugug

SEQ ID NO: 3803 - RNA, 16 nt, Hepatitis C virus
agguucccgcucauug

SEQ ID NO: 3804 - RNA, 22 nt, Hepatitis C virus
ugccugggauucccuuuguguc

SEQ ID NO: 3805 - RNA, 20 nt, Hepatitis C virus
guauaggggggucuggcgag

SEQ ID NO: 3806 - RNA, 22 nt, Hepatitis C virus
ucaaguuaggggcgcuuacugg

SEQ ID NO: 3807 - RNA, 22 nt, Hepatitis C virus
uauaaccaucucaccccucuuc

SEQ ID NO: 3808 - RNA, 22 nt, Hepatitis C virus
ccucuccuccugcuccugcugg

SEQ ID NO: 3809 - RNA, 22 nt, Hepatitis C virus
cgcacuggacacggagguggcc

SEQ ID NO: 3810 - RNA, 22 nt, Hepatitis C virus
aucgaggagguugcucugucca

SEQ ID NO: 3811 - RNA, 22 nt, Hepatitis C virus
caaggcuaucccccucgaggug

SEQ ID NO: 3812 - RNA, 22 nt, Hepatitis C virus
ugccgacgccuuaccgauuuug

SEQ ID NO: 3813 - RNA, 22 nt, Hepatitis C virus
cuaucaguuaugccaacggaag

SEQ ID NO: 3814 - RNA, 22 nt, Hepatitis C virus
cccuaacucgaguauuguguac

SEQ ID NO: 3815 - RNA, 20 nt, Hepatitis C virus
ccauccugcacacuccgggg

SEQ ID NO: 3816 - RNA, 22 nt, Hepatitis C virus
aacugccugggauucccuuugu

SEQ ID NO: 3817 - RNA, 22 nt, Hepatitis C virus
uaggggggucuggcgaggagac

SEQ ID NO: 3818 - RNA, 22 nt, Hepatitis C virus
gccuaccaagugcgcaauuccu

SEQ ID NO: 3819 - RNA, 17 nt, Hepatitis C virus
aguauuguguacgaggc

SEQ ID NO: 3820 - RNA, 22 nt, Hepatitis C virus
ccaucgugggaccagaugugga

SEQ ID NO: 3821 - RNA, 22 nt, Hepatitis C virus
cgccuuaaacccacccuccaug

SEQ ID NO: 3822 - RNA, 22 nt, Hepatitis C virus
aagacggcgugaacuaugcaac

SEQ ID NO: 3823 - RNA, 21 nt, Hepatitis C virus
ugguugcucuuucucuaucuu

SEQ ID NO: 3824 - RNA, 22 nt, Hepatitis C virus
uagcacggccuugaacugcaau

SEQ ID NO: 3825 - RNA, 21 nt, Hepatitis C virus
ugguuagcagggcucuucuau

SEQ ID NO: 3826 - RNA, 22 nt, Hepatitis C virus
agacccccggcguaggucgcgc

SEQ ID NO: 3827 - RNA, 22 nt, Hepatitis C virus
ugcggcuucgccgaccucaugg

SEQ ID NO: 3828 - RNA, 22 nt, Hepatitis C virus
ccuguacuccccuuccugcgcc

SEQ ID NO: 3829 - RNA, 22 nt, Hepatitis C virus
cgcuguggagggugucugcaga

SEQ ID NO: 3830 - RNA, 22 nt, Hepatitis C virus
uaacaccaaccgucgcccacag

SEQ ID NO: 3831 - RNA, 22 nt, Hepatitis C virus
cggguggcggucagaucguugg

SEQ ID NO: 3832 - RNA, 22 nt, Hepatitis C virus
ggcguaggucgcgcaauuuggg

SEQ ID NO: 3833 - RNA, 20 nt, Hepatitis C virus
cccuuacgugcggcuucgcc

SEQ ID NO: 3834 - RNA, 22 nt, Hepatitis C virus
ugucuuucuuguuggucaacug

SEQ ID NO: 3835 - RNA, 15 nt, Hepatitis C virus
cacuggacgacgcaa

SEQ ID NO: 3836 - RNA, 22 nt, Hepatitis C virus
uguucuucugcuuugcguggua

SEQ ID NO: 3837 - RNA, 20 nt, Hepatitis C virus
gugcccggagcggucuacgc

SEQ ID NO: 3838 - RNA, 22 nt, Hepatitis C virus
cacucccagccccgugguggug

SEQ ID NO: 3839 - RNA, 22 nt, Hepatitis C virus
gcgccuaccuacagcuggggug

SEQ ID NO: 3840 - RNA, 22 nt, Hepatitis C virus
ccucuccuccugcuccugcugg

SEQ ID NO: 3841 - RNA, 22 nt, Hepatitis C virus
cgcacuggacacggagguggcc

SEQ ID NO: 3842 - RNA, 22 nt, Hepatitis C virus
uccaauagcggccgcuggccgg

SEQ ID NO: 3843 - RNA, 22 nt, Hepatitis C virus
ugguucacggcuggcuacagcg

SEQ ID NO: 3844 - RNA, 22 nt, Hepatitis C virus
gccauuaccaggacgugcucaa

SEQ ID NO: 3845 - RNA, 19 nt, Hepatitis C virus
cggcgucaaaagugaaggc

SEQ ID NO: 3846 - RNA, 22 nt, Hepatitis C virus
agcagagacugcgggggcgaga

SEQ ID NO: 3847 - RNA, 22 nt, Hepatitis C virus
ucgccacugcuaccccuccggg

SEQ ID NO: 3848 - RNA, 22 nt, Hepatitis C virus
accagcagugccccagagcuuc

SEQ ID NO: 3849 - RNA, 20 nt, Hepatitis C virus
augcucccaccggcagcggu

SEQ ID NO: 3850 - RNA, 22 nt, Hepatitis C virus
ggcaaacuccccacaacgcagc

SEQ ID NO: 3851 - RNA, 20 nt, Hepatitis C virus
aucugcuugucgggagcgcc

SEQ ID NO: 3852 - RNA, 22 nt, Hepatitis C virus
uggagcugagaucacuggacau

SEQ ID NO: 3853 - RNA, 21 nt, Hepatitis C virus
cgaugaggaucgucgguccua

SEQ ID NO: 3854 - RNA, 22 nt, Hepatitis C virus
uagagacguggaaaaagccuga

SEQ ID NO: 3855 - RNA, 20 nt, Hepatitis C virus
ugguccauggcugcccgcua

SEQ ID NO: 3856 - RNA, 22 nt, Hepatitis C virus
gggauacaauacuuggcgggcc

SEQ ID NO: 3857 - RNA, 19 nt, Hepatitis C virus
guaaccccgccauugcuuc

SEQ ID NO: 3858 - RNA, 22 nt, Hepatitis C virus
ucgccgcccccggugccgcuac

SEQ ID NO: 3859 - RNA, 22 nt, Hepatitis C virus
uggcuuagcuggcgccgccauc

SEQ ID NO: 3860 - RNA, 22 nt, Hepatitis C virus
gaguuuacuuguugccgcgcag

SEQ ID NO: 3861 - RNA, 22 nt, Hepatitis C virus
ugcgcgcgacgaggaagacuuc

SEQ ID NO: 3862 - RNA, 22 nt, Hepatitis C virus
acacccugcaccugcggcuccu

SEQ ID NO: 3863 - RNA, 15 nt, Hepatitis C virus
gaggcacgccgaugu

SEQ ID NO: 3864 - RNA, 22 nt, Hepatitis C virus
aauuuugggagggcgucuuuac

SEQ ID NO: 3865 - RNA, 22 nt, Hepatitis C virus
auagaugcccacuuucuauccc

SEQ ID NO: 3866 - RNA, 22 nt, Hepatitis C virus
uaccaggaguucgaugagaugg

SEQ ID NO: 3867 - RNA, 22 nt, Hepatitis C virus
uaccguacaucgagcaagggau

SEQ ID NO: 3868 - RNA, 22 nt, Hepatitis C virus
uggacaugaucgcuggugcuca

SEQ ID NO: 3869 - RNA, 22 nt, Hepatitis C virus
ggcauagcguauuucuccaugg

SEQ ID NO: 3870 - RNA, 22 nt, Hepatitis C virus
ggaauugccaggacgaccgggu

SEQ ID NO: 3871 - RNA, 22 nt, Hepatitis C virus
cgcucaaugccuggagauuugg

SEQ ID NO: 3872 - RNA, 22 nt, Hepatitis C virus
agagacguggaaaaagccugac

SEQ ID NO: 3873 - RNA, 22 nt, Hepatitis C virus
uccauggcugcccgcuaccacc

SEQ ID NO: 3874 - RNA, 22 nt, Hepatitis C virus
ccaucacguacuccaccuacgg

SEQ ID NO: 3875 - RNA, 20 nt, Hepatitis C virus
gacggcgggugcucaggagg

SEQ ID NO: 3876 - RNA, 22 nt, Hepatitis C virus
aucaagucccucacugagaggc

SEQ ID NO: 3877 - RNA, 22 nt, Hepatitis C virus
cucuuaccaauucaagggggga

SEQ ID NO: 3878 - RNA, 22 nt, Hepatitis C virus
ccuguacuccccuuccugcgcc

SEQ ID NO: 3879 - RNA, 22 nt, Hepatitis C virus
cgcuguggagggugucugcaga

SEQ ID NO: 3880 - RNA, 22 nt, Hepatitis C virus
uugaguccuauucuuccaugcc

SEQ ID NO: 3881 - RNA, 22 nt, Hepatitis C virus
ccuggggauccggaucucagcg

SEQ ID NO: 3882 - RNA, 22 nt, Hepatitis C virus
gccccuacugcuggcacuaccc

SEQ ID NO: 3883 - RNA, 20 nt, Hepatitis C virus
gcauugugcccgcaaagagc

SEQ ID NO: 3884 - RNA, 22 nt, Hepatitis C virus
ggcccugcucucuugccugacu

SEQ ID NO: 3885 - RNA, 22 nt, Hepatitis C virus
agccuaccaagugcgcaauucc

SEQ ID NO: 3886 - RNA, 22 nt, Hepatitis C virus
ugagugcuaugacgcgggcugu

SEQ ID NO: 3887 - RNA, 20 nt, Hepatitis C virus
cucacgcccgccgagacuac

SEQ ID NO: 3888 - RNA, 22 nt, Hepatitis C virus
ugcuagccgaguaguguugggu

SEQ ID NO: 3889 - RNA, 21 nt, Hepatitis C virus
uugugguacugccugauaggg

SEQ ID NO: 3890 - RNA, 22 nt, Hepatitis C virus
uucuguccagaggaggcagggc

SEQ ID NO: 3891 - RNA, 22 nt, Hepatitis C virus
uaccucuucaacugggcaguaa

SEQ ID NO: 3892 - RNA, 22 nt, Hepatitis C virus
gggcuccgucacugugucccau

SEQ ID NO: 3893 - RNA, 20 nt, Hepatitis C virus
agguugcucuguccaccacc

SEQ ID NO: 3894 - RNA, 22 nt, Hepatitis C virus
ggccgaccuggaggucgucacg

SEQ ID NO: 3895 - RNA, 22 nt, Hepatitis C virus
guuggcggcguccuggcugcuc

SEQ ID NO: 3896 - RNA, 22 nt, Hepatitis C virus
uggacaugaucgcuggugcuca

SEQ ID NO: 3897 - RNA, 22 nt, Hepatitis C virus
ggcauagcguauuucuccaugg

SEQ ID NO: 3898 - RNA, 22 nt, Hepatitis C virus
ccuaccaagugcgcaauuccuc

SEQ ID NO: 3899 - RNA, 22 nt, Hepatitis C virus
aguauuguguacgaggcggccg

SEQ ID NO: 3900 - RNA, 22 nt, Hepatitis C virus
ugugagugcuaugacgcgggcu

SEQ ID NO: 3901 - RNA, 22 nt, Hepatitis C virus
cacgcccgccgagacuacaguu

SEQ ID NO: 3902 - RNA, 22 nt, Hepatitis C virus
ucuaucagcacaaauucaacuc

SEQ ID NO: 3903 - RNA, 20 nt, Hepatitis C virus
agagguuggccagcugccga

SEQ ID NO: 3904 - RNA, 22 nt, Hepatitis C virus
cguucaaggccuucuccggauc

SEQ ID NO: 3905 - RNA, 22 nt, Hepatitis C virus
gaagauagccggaggucauuac

SEQ ID NO: 3906 - RNA, 22 nt, Hepatitis C virus
uuggccgagcuugccaccaaaa

SEQ ID NO: 3907 - RNA, 22 nt, Hepatitis C virus
agcuccucaacuuccggcauua

SEQ ID NO: 3908 - RNA, 22 nt, Hepatitis C virus
uauaggcuuuggcacuauccuu

SEQ ID NO: 3909 - RNA, 22 nt, Hepatitis C virus
accauauucaaagucaggaugu

SEQ ID NO: 3910 - RNA, 22 nt, Hepatitis C virus
aauagcggccgcuggccggcug

SEQ ID NO: 3911 - RNA, 22 nt, Hepatitis C virus
uugguucacggcuggcuacagc

SEQ ID NO: 3912 - RNA, 22 nt, Hepatitis C virus
aagaugucgugugcugcucaau

SEQ ID NO: 3913 - RNA, 19 nt, Hepatitis C virus
acaggcgcacucgucaccc

SEQ ID NO: 3914 - RNA, 22 nt, Hepatitis C virus
uucgagacugggcgcacaacgg

SEQ ID NO: 3915 - RNA, 22 nt, Hepatitis C virus
guggcuguggaaccagucgucu

SEQ ID NO: 3916 - RNA, 22 nt, Hepatitis C virus
acccuaccuuuaccauugagac

SEQ ID NO: 3917 - RNA, 20 nt, Hepatitis C virus
ugucuccaggacucaacgcc

SEQ ID NO: 3918 - RNA, 22 nt, Hepatitis C virus
uauuugacaucaccaaacuacu

SEQ ID NO: 3919 - RNA, 20 nt, Hepatitis C virus
accccuuuggauucuucaag

SEQ ID NO: 3920 - RNA, 22 nt, Hepatitis C virus
augaacugguccccuacggcag

SEQ ID NO: 3921 - RNA, 20 nt, Hepatitis C virus
ugcuccggaucccacaagcc

SEQ ID NO: 3922 - RNA, 22 nt, Hepatitis C virus
ucaaggcccgggcagccugucg

SEQ ID NO: 3923 - RNA, 20 nt, Hepatitis C virus
aggacugcaccaugcucgug

SEQ ID NO: 3924 - RNA, 22 nt, Hepatitis C virus
cacggccuugaacugcaaugaa

SEQ ID NO: 3925 - RNA, 19 nt, Hepatitis C virus
cugguuagcagggcucuuc

SEQ ID NO: 3926 - RNA, 22 nt, Hepatitis C virus
ucagcuggugcaugugguggcu

SEQ ID NO: 3927 - RNA, 20 nt, Hepatitis C virus
aguagaagcgcaacugcacg

SEQ ID NO: 3928 - RNA, 22 nt, Hepatitis C virus
cauugggcaucaaugccguggc

SEQ ID NO: 3929 - RNA, 22 nt, Hepatitis C virus
gcggucuugacgugucugucau

SEQ ID NO: 3930 - RNA, 22 nt, Hepatitis C virus
gaaaacugcggcuaccgcaggu

SEQ ID NO: 3931 - RNA, 22 nt, Hepatitis C virus
cugacaacuagcugugguaaca

SEQ ID NO: 3932 - RNA, 22 nt, Hepatitis C virus
ugggcaauugguucgguuguac

SEQ ID NO: 3933 - RNA, 22 nt, Hepatitis C virus
acuggauucaccaaagugugcg

SEQ ID NO: 3934 - RNA, 22 nt, Hepatitis C virus
uccaugcucacugaucccuccc

SEQ ID NO: 3935 - RNA, 21 nt, Hepatitis C virus
ggcggccgggagaagguuggc

SEQ ID NO: 3936 - RNA, 22 nt, Hepatitis C virus
uacucaaugcagcaucccuggc

SEQ ID NO: 3937 - RNA, 22 nt, Hepatitis C virus
uguccuuccucguguucuucug

SEQ ID NO: 3938 - RNA, 22 nt, Hepatitis C virus
ccgugcgccggcgaggugauag

SEQ ID NO: 3939 - RNA, 22 nt, Hepatitis C virus
uuucgccccggcccauuuccua

SEQ ID NO: 3940 - RNA, 22 nt, Human herpesvirus 4
uaacccuaauucgauagcauau

SEQ ID NO: 3941 - RNA, 22 nt, Human herpesvirus 4
uaugcuauugaauuaggguuag

SEQ ID NO: 3942 - RNA, 22 nt, Human herpesvirus 4
ucccugaggcccuucuuccuuu

SEQ ID NO: 3943 - RNA, 22 nt, Human herpesvirus 4
ggaagaaaggugggcuuugagg

SEQ ID NO: 3944 - RNA, 22 nt, Human herpesvirus 4
ucuggcccaacggccaccuuug

SEQ ID NO: 3945 - RNA, 22 nt, Human herpesvirus 4
cugguggccgacacuuaucugg

SEQ ID NO: 3946 - RNA, 22 nt, Human herpesvirus 4
ccgcaggggugguggaugugcg

SEQ ID NO: 3947 - RNA, 22 nt, Human herpesvirus 4
ugcuucuaccaagacucccuga

SEQ ID NO: 3948 - RNA, 22 nt, Human herpesvirus 4
uauaugcuauccuaauuuauau

SEQ ID NO: 3949 - RNA, 22 nt, Human herpesvirus 4
aaauaucuggauagcauaugcu

SEQ ID NO: 3950 - RNA, 22 nt, Human herpesvirus 4
uggacgcagcacuuaucagcgc

SEQ ID NO: 3951 - RNA, 22 nt, Human herpesvirus 4
gcaaaggucaaguagcugcguc

SEQ ID NO: 3952 - RNA, 22 nt, Human herpesvirus 4
uuguguacgacgaugaugucau

SEQ ID NO: 3953 - RNA, 20 nt, Human herpesvirus 4
uucaucgucagugucacagc

SEQ ID NO: 3954 - RNA, 22 nt, Human herpesvirus 4
agacaggggaggggguuuggau

SEQ ID NO: 3955 - RNA, 22 nt, Human herpesvirus 4
ucaaugacaccuucauaucccu

SEQ ID NO: 3956 - RNA, 22 nt, Human herpesvirus 4
ugcuacccggauacagauuagg

SEQ ID NO: 3957 - RNA, 22 nt, Human herpesvirus 4
cagauauagauuaggauagcau

SEQ ID NO: 3958 - RNA, 22 nt, Human herpesvirus 4
gccacguagccuauuugcacgu

SEQ ID NO: 3959 - RNA, 17 nt, Human herpesvirus 4
augaggcugaugauggc

SEQ ID NO: 3960 - RNA, 22 nt, Human herpesvirus 4
gacgcagcacuuaucagcgcug

SEQ ID NO: 3961 - RNA, 22 nt, Human herpesvirus 4
ggggcaaaggucaaguagcugc

SEQ ID NO: 3962 - RNA, 22 nt, Human herpesvirus 4
ccugacaucugugacgcacggu

SEQ ID NO: 3963 - RNA, 22 nt, Human herpesvirus 4
acauccauauaaauucuucgau

SEQ ID NO: 3964 - RNA, 22 nt, Human herpesvirus 4
acccuaauucaauagcauaugu

SEQ ID NO: 3965 - RNA, 22 nt, Human herpesvirus 4
auaugcuaucgaauuaggguua

SEQ ID NO: 3966 - RNA, 22 nt, Human herpesvirus 4
gagauggaggcccuggccgcuc

SEQ ID NO: 3967 - RNA, 22 nt, Human herpesvirus 4
gggagccgggcauccuucucuc

SEQ ID NO: 3968 - RNA, 22 nt, Human herpesvirus 4
uucaauaucaucaacuuuauug

SEQ ID NO: 3969 - RNA, 22 nt, Human herpesvirus 4
uggaauggagggggacacacuu

SEQ ID NO: 3970 - RNA, 22 nt, Human herpesvirus 4
caauuuccaugacagucccguu

SEQ ID NO: 3971 - RNA, 22 nt, Human herpesvirus 4
cagauagugaacguggagguug

SEQ ID NO: 3972 - RNA, 22 nt, Human herpesvirus 4
uggcggguggagauagggacca

SEQ ID NO: 3973 - RNA, 22 nt, Human herpesvirus 4
cuaacugugucccacuccaccu

SEQ ID NO: 3974 - RNA, 22 nt, Human herpesvirus 4
ggcggcccagacagaggagagg

SEQ ID NO: 3975 - RNA, 22 nt, Human herpesvirus 4
uuaucucucggcggcugccgcc

SEQ ID NO: 3976 - RNA, 22 nt, Human herpesvirus 4
uaaggcuaguccgauccccggg

SEQ ID NO: 3977 - RNA, 22 nt, Human herpesvirus 4
cuauggauuggaccaaccuuaa

SEQ ID NO: 3978 - RNA, 22 nt, Human herpesvirus 4
uccuccccauucuccuucuccu

SEQ ID NO: 3979 - RNA, 22 nt, Human herpesvirus 4
gacgagggagagggaggggagg

SEQ ID NO: 3980 - RNA, 22 nt, Human herpesvirus 4
ggcccccugguggagaauauaa

SEQ ID NO: 3981 - RNA, 22 nt, Human herpesvirus 4
auaaaaucaccacgguggucca

SEQ ID NO: 3982 - RNA, 22 nt, Human herpesvirus 4
ucugguuguugccguugacccc

SEQ ID NO: 3983 - RNA, 20 nt, Human herpesvirus 4
cuggcagcgugacaaccgga

SEQ ID NO: 3984 - RNA, 22 nt, Human herpesvirus 4
uggcggccaagcgccuggggga

SEQ ID NO: 3985 - RNA, 22 nt, Human herpesvirus 4
ucccagugcgugcccguuaacc

SEQ ID NO: 3986 - RNA, 22 nt, Human herpesvirus 4
ugacggccccuccgugccccua

SEQ ID NO: 3987 - RNA, 18 nt, Human herpesvirus 4
gcacaggcggccgugcag

SEQ ID NO: 3988 - RNA, 22 nt, Human herpesvirus 4
gggccuggccggccuugggcuc

SEQ ID NO: 3989 - RNA, 22 nt, Human herpesvirus 4
gucugaggaugagucuaauuuc

SEQ ID NO: 3990 - RNA, 22 nt, Human herpesvirus 4
gguagcggaggggcagacgccc

SEQ ID NO: 3991 - RNA, 22 nt, Human herpesvirus 4
cucgcccgcgugacgcgucagu

SEQ ID NO: 3992 - RNA, 22 nt, Human herpesvirus 4
aaguggagggggaucgcccggg

SEQ ID NO: 3993 - RNA, 22 nt, Human herpesvirus 4
cgggcgauccucugagacccuc

SEQ ID NO: 3994 - RNA, 22 nt, Human herpesvirus 4
agugggggucaaacaaguagaa

SEQ ID NO: 3995 - RNA, 22 nt, Human herpesvirus 4
ucucgaugaugauggcccccgc

SEQ ID NO: 3996 - RNA, 22 nt, Human herpesvirus 4
ccccgggugggauccauggcug

SEQ ID NO: 3997 - RNA, 20 nt, Human herpesvirus 4
gaggccggcccgcccggcgg

SEQ ID NO: 3998 - RNA, 22 nt, Human herpesvirus 4
ucuaggagccucaauauucaug

SEQ ID NO: 3999 - RNA, 22 nt, Human herpesvirus 4
gccagaucaaucuccucguuug

SEQ ID NO: 4000 - RNA, 22 nt, Human herpesvirus 4
gggguccaggagucugcugcgg

SEQ ID NO: 4001 - RNA, 22 nt, Human herpesvirus 4
cagcccauaccuauagauccug

SEQ ID NO: 4002 - RNA, 22 nt, Human herpesvirus 4
uggucuuugcaggacuauaccu

SEQ ID NO: 4003 - RNA, 17 nt, Human herpesvirus 4
ucggaugugaaagaucg

SEQ ID NO: 4004 - RNA, 22 nt, Human herpesvirus 4
ugucaccggugaugcgccugac

SEQ ID NO: 4005 - RNA, 18 nt, Human herpesvirus 4
uguugggcuggugacauc

SEQ ID NO: 4006 - RNA, 22 nt, Human herpesvirus 4
gcugcugcuugucgaggauggu

SEQ ID NO: 4007 - RNA, 19 nt, Human herpesvirus 4
cucgcaggccgccagcagc

SEQ ID NO: 4008 - RNA, 22 nt, Human herpesvirus 4
gauuuccuggcuccgugacaag

SEQ ID NO: 4009 - RNA, 21 nt, Human herpesvirus 4
ucacccugccggagaagauuc

SEQ ID NO: 4010 - RNA, 22 nt, Human herpesvirus 4
ucccucaguguuugccagcuua

SEQ ID NO: 4011 - RNA, 17 nt, Human herpesvirus 4
uguggacaccugaggga

SEQ ID NO: 4012 - RNA, 22 nt, Human herpesvirus 4
uggauccaggagcuguuucgca

SEQ ID NO: 4013 - RNA, 22 nt, Human herpesvirus 4
ucaucgaggcucguggagaggg

SEQ ID NO: 4014 - RNA, 22 nt, Human herpesvirus 4
uaaggggacaccaggcauacaa

SEQ ID NO: 4015 - RNA, 21 nt, Human herpesvirus 4
uguaugccugcguccucuuag

SEQ ID NO: 4016 - RNA, 22 nt, Human herpesvirus 4
ccuuagagguggagcaacgucu

SEQ ID NO: 4017 - RNA, 22 nt, Human herpesvirus 4
gcggggcugggcaaaggggucc

SEQ ID NO: 4018 - RNA, 22 nt, Human herpesvirus 4
ucgggucaucgggcauaucggc

SEQ ID NO: 4019 - RNA, 22 nt, Human herpesvirus 4
ccgucugaccgagaaccuaaga

SEQ ID NO: 4020 - RNA, 22 nt, Human herpesvirus 4
ggauaagaaacacgcuggcuuu

SEQ ID NO: 4021 - RNA, 20 nt, Human herpesvirus 4
agcgucauuucuuccaaucc

SEQ ID NO: 4022 - RNA, 22 nt, Human herpesvirus 4
uacucccggaagaugcccucca

SEQ ID NO: 4023 - RNA, 22 nt, Human herpesvirus 4
aggcacgcuguucgucccguga

SEQ ID NO: 4024 - RNA, 22 nt, Human herpesvirus 4
uccaucagcucucuuuuccccg

SEQ ID NO: 4025 - RNA, 20 nt, Human herpesvirus 4
cuggagcugaaguugaugga

SEQ ID NO: 4026 - RNA, 22 nt, Human herpesvirus 4
cagcgcccggcacagaauuugc

SEQ ID NO: 4027 - RNA, 20 nt, Human herpesvirus 4
gugagcccccggguacgcug

SEQ ID NO: 4028 - RNA, 22 nt, Human herpesvirus 4
ugaggccugggaucguuguugg

SEQ ID NO: 4029 - RNA, 20 nt, Human herpesvirus 4
cacuagcagcagguucucag

SEQ ID NO: 4030 - RNA, 22 nt, Human herpesvirus 4
uggacgcagcuacuugaccuuu

SEQ ID NO: 4031 - RNA, 20 nt, Human herpesvirus 4
gcugauaagugcugcgucca

SEQ ID NO: 4032 - RNA, 22 nt, Human herpesvirus 4
ggggccuggguaguagcgggca

SEQ ID NO: 4033 - RNA, 21 nt, Human herpesvirus 4
ugcaaucaaaccccaggcucc

SEQ ID NO: 4034 - RNA, 22 nt, Human herpesvirus 4
ccuauagguuauuaaccuagug

SEQ ID NO: 4035 - RNA, 21 nt, Human herpesvirus 4
gcuggguauauaccuauaggu

SEQ ID NO: 4036 - RNA, 22 nt, Human herpesvirus 4
uagcaggcaugucuucauuccu

SEQ ID NO: 4037 - RNA, 19 nt, Human herpesvirus 4
ugaaggcacagccuguuac

SEQ ID NO: 4038 - RNA, 22 nt, Human herpesvirus 4
gagcggggcagcggacccagcg

SEQ ID NO: 4039 - RNA, 22 nt, Human herpesvirus 4
ggccacccggccgccccccgag

SEQ ID NO: 4040 - RNA, 22 nt, Human herpesvirus 4
gagcggggcagcggacccagcg

SEQ ID NO: 4041 - RNA, 22 nt, Human herpesvirus 4
ggccacccggccgccccccgag

SEQ ID NO: 4042 - RNA, 22 nt, Human herpesvirus 4
gagcggggcagcggacccagcg

SEQ ID NO: 4043 - RNA, 22 nt, Human herpesvirus 4
ggccacccggccgccccccgag

SEQ ID NO: 4044 - RNA, 22 nt, Human herpesvirus 4
gagcggggcagcggacccagcg

SEQ ID NO: 4045 - RNA, 22 nt, Human herpesvirus 4
ggccacccggccgccccccgag

SEQ ID NO: 4046 - RNA, 22 nt, Human herpesvirus 4
gagcggggcagcggacccagcg

SEQ ID NO: 4047 - RNA, 22 nt, Human herpesvirus 4
ggccacccggccgccccccgag

SEQ ID NO: 4048 - RNA, 22 nt, Human herpesvirus 4
gagcggggcagcggacccagcg

SEQ ID NO: 4049 - RNA, 22 nt, Human herpesvirus 4
ggccacccggccgccccccgag

SEQ ID NO: 4050 - RNA, 22 nt, Human herpesvirus 4
gagcggggcagcggacccagcg

SEQ ID NO: 4051 - RNA, 22 nt, Human herpesvirus 4
ggccacccggccgccccccgag

SEQ ID NO: 4052 - RNA, 22 nt, Human herpesvirus 4
gagcggggcagcggacccagcg

SEQ ID NO: 4053 - RNA, 22 nt, Human herpesvirus 4
ggccacccggccgccccccgag

SEQ ID NO: 4054 - RNA, 22 nt, Human herpesvirus 4
gagcggggcagcggacccagcg

SEQ ID NO: 4055 - RNA, 22 nt, Human herpesvirus 4
ggccacccggccgccccccgag

SEQ ID NO: 4056 - RNA, 22 nt, Human herpesvirus 4
gagcggggcagcggacccagcg

SEQ ID NO: 4057 - RNA, 22 nt, Human herpesvirus 4
ggccacccggccgccccccgag

SEQ ID NO: 4058 - RNA, 22 nt, Human herpesvirus 4
gagcggggcagcggacccagcg

SEQ ID NO: 4059 - RNA, 22 nt, Human herpesvirus 4
ggccacccggccgccccccgag

SEQ ID NO: 4060 - RNA, 22 nt, Human herpesvirus 4
gagcggggcagcggacccagcg

SEQ ID NO: 4061 - RNA, 22 nt, Human herpesvirus 4
ggccacccggccgccccccgag

SEQ ID NO: 4062 - RNA, 22 nt, Human herpesvirus 4
gagcggggcagcggacccagcg

SEQ ID NO: 4063 - RNA, 22 nt, Human herpesvirus 4
ggccacccggccgccccccgag

SEQ ID NO: 4064 - RNA, 22 nt, Human herpesvirus 4
uucacuagugaaggcaacuaac

SEQ ID NO: 4065 - RNA, 22 nt, Human herpesvirus 4
uaguugugcccacugguguuua

SEQ ID NO: 4066 - RNA, 22 nt, Human herpesvirus 4
gcauucccaagcaaacaaaaca

SEQ ID NO: 4067 - RNA, 22 nt, Human herpesvirus 4
ugucauguuugcggggaauguu

SEQ ID NO: 4068 - RNA, 22 nt, Human herpesvirus 4
gccggcugcagccggguccggg

SEQ ID NO: 4069 - RNA, 22 nt, Human herpesvirus 4
uggagcucggggggcggccggg

SEQ ID NO: 4070 - RNA, 22 nt, Human herpesvirus 4
gccggcugcagccggguccggg

SEQ ID NO: 4071 - RNA, 22 nt, Human herpesvirus 4
uggagcucggggggcggccggg

SEQ ID NO: 4072 - RNA, 22 nt, Human herpesvirus 4
gccggcugcagccggguccggg

SEQ ID NO: 4073 - RNA, 22 nt, Human herpesvirus 4
uggagcucggggggcggccggg

SEQ ID NO: 4074 - RNA, 22 nt, Human herpesvirus 4
gccggcugcagccggguccggg

SEQ ID NO: 4075 - RNA, 22 nt, Human herpesvirus 4
uggagcucggggggcggccggg

SEQ ID NO: 4076 - RNA, 22 nt, Human herpesvirus 4
uaggcauagagagugaugagcc

SEQ ID NO: 4077 - RNA, 22 nt, Human herpesvirus 4
guucaugaucagcuacugccug

SEQ ID NO: 4078 - RNA, 22 nt, Human herpesvirus 4
uccaauaaguagauccagauac

SEQ ID NO: 4079 - RNA, 22 nt, Human herpesvirus 4
uguuaggguuggaaaagugggg

SEQ ID NO: 4080 - RNA, 22 nt, Human herpesvirus 4
uccgcugacccuguccgugugc

SEQ ID NO: 4081 - RNA, 22 nt, Human herpesvirus 4
ucccacgguggggugugacagg

SEQ ID NO: 4082 - RNA, 22 nt, Human herpesvirus 4
uuauuuucuccaaaucgcuccu

SEQ ID NO: 4083 - RNA, 20 nt, Human herpesvirus 4
agggcgaaugcagaaaauag

SEQ ID NO: 4084 - RNA, 22 nt, Human herpesvirus 4
cgccuucaagugcaucgaagag

SEQ ID NO: 4085 - RNA, 22 nt, Human herpesvirus 4
ugcaugagaaguacgaggccgu

SEQ ID NO: 4086 - RNA, 22 nt, Human herpesvirus 4
cggagggucucagaggaucgcc

SEQ ID NO: 4087 - RNA, 22 nt, Human herpesvirus 4
ccgggcgaucccccuccacuuc

SEQ ID NO: 4088 - RNA, 22 nt, Human herpesvirus 4
ucuggaggacaaauuacacaca

SEQ ID NO: 4089 - RNA, 22 nt, Human herpesvirus 4
gguuguugguccucauauucac

SEQ ID NO: 4090 - RNA, 22 nt, Human herpesvirus 4
ccagcgugaggucuuauuuuug

SEQ ID NO: 4091 - RNA, 22 nt, Human herpesvirus 4
ggauauuauaaaacaggucauu

SEQ ID NO: 4092 - RNA, 22 nt, Human herpesvirus 4
ggggcuggcgaggcggcguccg

SEQ ID NO: 4093 - RNA, 21 nt, Human herpesvirus 4
auguggcccugagucaguccc

SEQ ID NO: 4094 - RNA, 22 nt, Human herpesvirus 4
uuaaguucgggggucagggggg

SEQ ID NO: 4095 - RNA, 22 nt, Human herpesvirus 4
caaauccucugucauggacucu

SEQ ID NO: 4096 - RNA, 22 nt, Human herpesvirus 4
uggguccgcugggccgcugccc

SEQ ID NO: 4097 - RNA, 21 nt, Human herpesvirus 4
ggguggccccgcugggcaccg

SEQ ID NO: 4098 - RNA, 22 nt, Human herpesvirus 4
uggcggcuggagagaaggaugc

SEQ ID NO: 4099 - RNA, 21 nt, Human herpesvirus 4
gccuccaucucugccgccauc

SEQ ID NO: 4100 - RNA, 22 nt, Human herpesvirus 4
cggagccucaggaggguccccu

SEQ ID NO: 4101 - RNA, 22 nt, Human herpesvirus 4
agggggaggauugggcuccgcc

SEQ ID NO: 4102 - RNA, 22 nt, Human herpesvirus 4
cggucuacauacacgcgcguca

SEQ ID NO: 4103 - RNA, 19 nt, Human herpesvirus 4
ugaccgcguuguagcacug

SEQ ID NO: 4104 - RNA, 22 nt, Human herpesvirus 4
ucugaccggggugcugccggcc

SEQ ID NO: 4105 - RNA, 22 nt, Human herpesvirus 4
gcggcggcuucccugacugaag

SEQ ID NO: 4106 - RNA, 22 nt, Human herpesvirus 4
uccaagcggcacagauuagaag

SEQ ID NO: 4107 - RNA, 22 nt, Human herpesvirus 4
ucuacaucaugccugguucggu

SEQ ID NO: 4108 - RNA, 22 nt, Human herpesvirus 4
ggccccccagcccccccgcaca

SEQ ID NO: 4109 - RNA, 19 nt, Human herpesvirus 4
gggcgggcggcgggggguc

SEQ ID NO: 4110 - RNA, 22 nt, Human herpesvirus 4
gggggaccugaccugcaugcuc

SEQ ID NO: 4111 - RNA, 22 nt, Human herpesvirus 4
cauccagguccuggcggaucuc

SEQ ID NO: 4112 - RNA, 22 nt, Human herpesvirus 4
ccuuguugaauaggccaucuug

SEQ ID NO: 4113 - RNA, 22 nt, Human herpesvirus 4
agaucuggcacaaauguaauua

SEQ ID NO: 4114 - RNA, 22 nt, Human herpesvirus 4
cguccuugcggcggccuccccc

SEQ ID NO: 4115 - RNA, 22 nt, Human herpesvirus 4
gcgcggggucccugccuggcac

SEQ ID NO: 4116 - RNA, 22 nt, Human herpesvirus 4
uagucggacacgugcauggacc

SEQ ID NO: 4117 - RNA, 20 nt, Human herpesvirus 4
gucgcaggcacucguacugc

SEQ ID NO: 4118 - RNA, 22 nt, Human herpesvirus 4
uaaccggcucguggcucguaca

SEQ ID NO: 4119 - RNA, 22 nt, Human herpesvirus 4
uaacuugccagggacggcugac

SEQ ID NO: 4120 - RNA, 22 nt, Human herpesvirus 4
gcggccgccagggcccgggucu

SEQ ID NO: 4121 - RNA, 20 nt, Human herpesvirus 4
gagccguccagcggaucguc

SEQ ID NO: 4122 - RNA, 22 nt, Human herpesvirus 4
uuuccccaggcagucccagcgc

SEQ ID NO: 4123 - RNA, 21 nt, Human herpesvirus 4
gggcuguggaugguguggaag

SEQ ID NO: 4124 - RNA, 22 nt, Human herpesvirus 4
ugccaacauagaggcauuccug

SEQ ID NO: 4125 - RNA, 22 nt, Human herpesvirus 4
uguaugcccuguacuuggacgu

SEQ ID NO: 4126 - RNA, 22 nt, Human herpesvirus 4
uggcuuuucccuaugcgggccc

SEQ ID NO: 4127 - RNA, 22 nt, Human herpesvirus 4
uaccgacauucuaucaaccuaa

SEQ ID NO: 4128 - RNA, 22 nt, Human herpesvirus 4
gcucuuguguccaggcaucccu

SEQ ID NO: 4129 - RNA, 20 nt, Human herpesvirus 4
gggguggugggggcgggggu

SEQ ID NO: 4130 - RNA, 22 nt, Human herpesvirus 4
ucugggaggaaguuuuaacacc

SEQ ID NO: 4131 - RNA, 22 nt, Human herpesvirus 4
uguuucauuuauggaauuccua

SEQ ID NO: 4132 - RNA, 22 nt, Human herpesvirus 4
cgggcgcagccaugcgugaccg

SEQ ID NO: 4133 - RNA, 18 nt, Human herpesvirus 4
ucgcagggggugugucug

SEQ ID NO: 4134 - RNA, 22 nt, Human herpesvirus 4
cgggcgcagccaugcgugaccg

SEQ ID NO: 4135 - RNA, 18 nt, Human herpesvirus 4
ucgcagggggugugucug

SEQ ID NO: 4136 - RNA, 22 nt, Human herpesvirus 4
cgggcgcagccaugcgugaccg

SEQ ID NO: 4137 - RNA, 18 nt, Human herpesvirus 4
ucgcagggggugugucug

SEQ ID NO: 4138 - RNA, 22 nt, Human herpesvirus 4
uauuuucugcauucgcccuugc

SEQ ID NO: 4139 - RNA, 22 nt, Human herpesvirus 4
aaggagcgauuuggagaaaaua

SEQ ID NO: 4140 - RNA, 22 nt, Human herpesvirus 4
ucccucagguguccacaggccc

SEQ ID NO: 4141 - RNA, 22 nt, Human herpesvirus 4
ggaaauaagcuggcaaacacug

SEQ ID NO: 4142 - RNA, 22 nt, Human herpesvirus 4
ugaggcuagagauccaggcucg

SEQ ID NO: 4143 - RNA, 21 nt, Human herpesvirus 4
cagagcagggcauaguccuca

SEQ ID NO: 4144 - RNA, 22 nt, Human herpesvirus 4
cgccgcguuugugggacuggaa

SEQ ID NO: 4145 - RNA, 22 nt, Human herpesvirus 4
caccccggucagaagccaggug

SEQ ID NO: 4146 - RNA, 22 nt, Human herpesvirus 4
ucuaaugcguagcagccacucu

SEQ ID NO: 4147 - RNA, 21 nt, Human herpesvirus 4
aagguggcuggugauuggagg

SEQ ID NO: 4148 - RNA, 22 nt, Human herpesvirus 4
uccauaggcgacguggacgggg

SEQ ID NO: 4149 - RNA, 20 nt, Human herpesvirus 4
uguauaaugacuaugaggag

SEQ ID NO: 4150 - RNA, 22 nt, Human herpesvirus 4
cguggucaugugcagcuugcau

SEQ ID NO: 4151 - RNA, 18 nt, Human herpesvirus 4
ugacgccugacuuucacg

SEQ ID NO: 4152 - RNA, 22 nt, Human herpesvirus 4
uggcuggacggaggacgauagc

SEQ ID NO: 4153 - RNA, 22 nt, Human herpesvirus 4
caccuguccuugucugcugcca

SEQ ID NO: 4154 - RNA, 22 nt, Human herpesvirus 4
ggggguucuugcuaaugggaaa

SEQ ID NO: 4155 - RNA, 22 nt, Human herpesvirus 4
ccauguacagcacaaccuugga

SEQ ID NO: 4156 - RNA, 22 nt, Human herpesvirus 4
uaagccucccuuuaugugagcc

SEQ ID NO: 4157 - RNA, 22 nt, Human herpesvirus 4
cuuaccccugaaggugaaccgc

SEQ ID NO: 4158 - RNA, 22 nt, Human herpesvirus 4
aaacaccaguguccagagagga

SEQ ID NO: 4159 - RNA, 22 nt, Human herpesvirus 4
cugccucucaucuggaacggug

SEQ ID NO: 4160 - RNA, 22 nt, Human herpesvirus 4
cagggccauguguuccugcaug

SEQ ID NO: 4161 - RNA, 14 nt, Human herpesvirus 4
agagcuuggcccug

SEQ ID NO: 4162 - RNA, 22 nt, Human herpesvirus 4
ucugcccguuuacugauagaau

SEQ ID NO: 4163 - RNA, 20 nt, Human herpesvirus 4
uguuaguauucugaggcaga

SEQ ID NO: 4164 - RNA, 22 nt, Human herpesvirus 4
uugucauuuuucccaacgcagg

SEQ ID NO: 4165 - RNA, 20 nt, Human herpesvirus 4
agggcuugggaagugacagg

SEQ ID NO: 4166 - RNA, 22 nt, Human herpesvirus 4
uguuuuuggccauccucaagcu

SEQ ID NO: 4167 - RNA, 22 nt, Human herpesvirus 4
cuucauccagguccuuuccuac

SEQ ID NO: 4168 - RNA, 22 nt, Human herpesvirus 4
ucgcucaacuccacguucaucc

SEQ ID NO: 4169 - RNA, 19 nt, Human herpesvirus 4
guaccuuccgaggagcgac

SEQ ID NO: 4170 - RNA, 22 nt, Human herpesvirus 4
ugcuggaaguuaaccgccauaa

SEQ ID NO: 4171 - RNA, 22 nt, Human herpesvirus 4
uggccaccaacgucccugaguu

SEQ ID NO: 4172 - RNA, 22 nt, Human herpesvirus 4
uccaucaacuucagcuccaggg

SEQ ID NO: 4173 - RNA, 22 nt, Human herpesvirus 4
cggggaaaagagagcugaugga

SEQ ID NO: 4174 - RNA, 22 nt, Human herpesvirus 4
uaaacaaggaggaagaugccaa

SEQ ID NO: 4175 - RNA, 22 nt, Human herpesvirus 4
cuucacauuuaaccuguuuuau

SEQ ID NO: 4176 - RNA, 22 nt, Human herpesvirus 4
uaggcggacgaguggcuucgga

SEQ ID NO: 4177 - RNA, 20 nt, Human herpesvirus 4
ggccacagccgccucagaag

SEQ ID NO: 4178 - RNA, 22 nt, Human herpesvirus 4
aauacaaauaaauuucucuuac

SEQ ID NO: 4179 - RNA, 21 nt, Human herpesvirus 4
uguagugagguguuguguccu

SEQ ID NO: 4180 - RNA, 22 nt, Human herpesvirus 4
ccacgggcaaaacuugcgucaa

SEQ ID NO: 4181 - RNA, 20 nt, Human herpesvirus 4
agcuauucuuuuucccgugg

SEQ ID NO: 4182 - RNA, 22 nt, Human herpesvirus 4
gcugccccugaccaguuaggac

SEQ ID NO: 4183 - RNA, 21 nt, Human herpesvirus 4
ucuuuaacggcgcggugcagu

SEQ ID NO: 4184 - RNA, 22 nt, Human herpesvirus 4
agcggcacagauuagaagauga

SEQ ID NO: 4185 - RNA, 18 nt, Human herpesvirus 4
ucuacaucaugccugguu

SEQ ID NO: 4186 - RNA, 22 nt, Human herpesvirus 4
uugaguccaaacagcuaauuuc

SEQ ID NO: 4187 - RNA, 21 nt, Human herpesvirus 4
gucaccgcgaccaagacucaa

SEQ ID NO: 4188 - RNA, 22 nt, Human herpesvirus 4
uuggugcagguugggaggaaaa

SEQ ID NO: 4189 - RNA, 16 nt, Human herpesvirus 4
uccagcacauccgcau

SEQ ID NO: 4190 - RNA, 22 nt, Human herpesvirus 4
uccccuggccucuccuucccgc

SEQ ID NO: 4191 - RNA, 22 nt, Human herpesvirus 4
gguccaucaggccggccggagg

SEQ ID NO: 4192 - RNA, 22 nt, Human herpesvirus 4
ugccacccccccaaugccacac

SEQ ID NO: 4193 - RNA, 22 nt, Human herpesvirus 4
ugaaauaggcaagugcguuuau

SEQ ID NO: 4194 - RNA, 22 nt, Human herpesvirus 4
gcugcugcccgaagggagguga

SEQ ID NO: 4195 - RNA, 20 nt, Human herpesvirus 4
guuccagcccugucagcggc

SEQ ID NO: 4196 - RNA, 22 nt, Human herpesvirus 4
ccgggccguggaaugagggccu

SEQ ID NO: 4197 - RNA, 21 nt, Human herpesvirus 4
gcgccccauccgaagcccggg

SEQ ID NO: 4198 - RNA, 22 nt, Human herpesvirus 4
ggaagugcgaacuugagccagg

SEQ ID NO: 4199 - RNA, 16 nt, Human herpesvirus 4
caacaauaccacuucc

SEQ ID NO: 4200 - RNA, 22 nt, Human herpesvirus 4
aauaaggcucugaagcaacagg

SEQ ID NO: 4201 - RNA, 22 nt, Human herpesvirus 4
ugugccucgucuaccucuguuc

SEQ ID NO: 4202 - RNA, 22 nt, Human herpesvirus 4
gcuaguacugcagugggccucu

SEQ ID NO: 4203 - RNA, 22 nt, Human herpesvirus 4
ugacccuucugcugcugcuggu

SEQ ID NO: 4204 - RNA, 22 nt, Human herpesvirus 4
gcuucuucuugggcuucagcac

SEQ ID NO: 4205 - RNA, 20 nt, Human herpesvirus 4
ucauguagguuuuaggaggu

SEQ ID NO: 4206 - RNA, 22 nt, Human herpesvirus 4
aacgcccggguccuugcuaccu

SEQ ID NO: 4207 - RNA, 22 nt, Human herpesvirus 4
uguguuaagggcuggguaaagg

SEQ ID NO: 4208 - RNA, 22 nt, Human herpesvirus 4
uccgggcggccuccuuuuccag

SEQ ID NO: 4209 - RNA, 22 nt, Human herpesvirus 4
ggccaucuggaggcggcccugg

SEQ ID NO: 4210 - RNA, 22 nt, Human herpesvirus 4
acucggggcccuuuuugguuug

SEQ ID NO: 4211 - RNA, 22 nt, Human herpesvirus 4
gaggcagacaaggccccgccau

SEQ ID NO: 4212 - RNA, 22 nt, Human herpesvirus 4
ugcgccugagcucccgcuccca

SEQ ID NO: 4213 - RNA, 20 nt, Human herpesvirus 4
guucgguagucgagggcgcg

SEQ ID NO: 4214 - RNA, 22 nt, Human herpesvirus 4
gacgcagccccggaggccacgc

SEQ ID NO: 4215 - RNA, 22 nt, Human herpesvirus 4
uggucgccgggaugcuaauguu

SEQ ID NO: 4216 - RNA, 22 nt, Human herpesvirus 4
gguggcaugcaaaauaacugac

SEQ ID NO: 4217 - RNA, 21 nt, Human herpesvirus 4
uccucuuuugcugcagacacc

SEQ ID NO: 4218 - RNA, 22 nt, Human herpesvirus 4
cggggggucacgcgcaggcuua

SEQ ID NO: 4219 - RNA, 22 nt, Human herpesvirus 4
ucaggcuccguguccccccggg

SEQ ID NO: 4220 - RNA, 22 nt, Human herpesvirus 4
gcgcgcauaauggcggaccuag

SEQ ID NO: 4221 - RNA, 20 nt, Human herpesvirus 4
ucuaugguuggcugcgcugc

SEQ ID NO: 4222 - RNA, 22 nt, Human herpesvirus 4
ucaaggugaauauagcugccca

SEQ ID NO: 4223 - RNA, 22 nt, Human herpesvirus 4
gugggccgcuguucaccuaaag

SEQ ID NO: 4224 - RNA, 22 nt, Human herpesvirus 4
auccuggaccuugacuaugaaa

SEQ ID NO: 4225 - RNA, 22 nt, Human herpesvirus 4
auaguccaguguccagggacag

SEQ ID NO: 4226 - RNA, 22 nt, Human herpesvirus 4
agcaccaucagcccggggggac

SEQ ID NO: 4227 - RNA, 19 nt, Human herpesvirus 4
ugaccccccgccuggugcu

SEQ ID NO: 4228 - RNA, 22 nt, Human herpesvirus 4
uccccucccucucccucguccu

SEQ ID NO: 4229 - RNA, 21 nt, Human herpesvirus 4
aggagaaggagaauggggagg

SEQ ID NO: 4230 - RNA, 22 nt, Human herpesvirus 4
ugccuggcaaccuggucacuua

SEQ ID NO: 4231 - RNA, 22 nt, Human herpesvirus 4
cgugcggccagacccaguucua

SEQ ID NO: 4232 - RNA, 22 nt, Human herpesvirus 4
ucuggcaacgcccggguccuug

SEQ ID NO: 4233 - RNA, 22 nt, Human herpesvirus 4
agggcuggguaaaggugucugc

SEQ ID NO: 4234 - RNA, 22 nt, Human herpesvirus 4
agggccauguguuccugcaugu

SEQ ID NO: 4235 - RNA, 20 nt, Human herpesvirus 4
ugguggcagagcuuggcccu

SEQ ID NO: 4236 - RNA, 22 nt, Human herpesvirus 4
gcuucuuuucgcacgguguaug

SEQ ID NO: 4237 - RNA, 20 nt, Human herpesvirus 4
augccgguacugggauaggc

SEQ ID NO: 4238 - RNA, 22 nt, Human herpesvirus 4
caccgauuucuaggcagcaucc

SEQ ID NO: 4239 - RNA, 19 nt, Human herpesvirus 4
ggggggugcgguguuggug

SEQ ID NO: 4240 - RNA, 22 nt, Human herpesvirus 4
uuguggaccucucagaguuuca

SEQ ID NO: 4241 - RNA, 22 nt, Human herpesvirus 4
augcuggacggagauuuacaug

SEQ ID NO: 4242 - RNA, 22 nt, Human herpesvirus 4
gccgccagguccuggggcagcc

SEQ ID NO: 4243 - RNA, 22 nt, Human herpesvirus 4
cgcuccgggggcagccgggcgg

SEQ ID NO: 4244 - RNA, 22 nt, Human herpesvirus 4
gguggaacagaugcuguugagg

SEQ ID NO: 4245 - RNA, 22 nt, Human herpesvirus 4
ucuacgguguuuuuggcuugcu

SEQ ID NO: 4246 - RNA, 22 nt, Human herpesvirus 4
cggagggcugggcugcgccucu

SEQ ID NO: 4247 - RNA, 22 nt, Human herpesvirus 4
gagcgcgcccggcccccugcca

SEQ ID NO: 4248 - RNA, 22 nt, Human herpesvirus 4
uggaagggaagacacgucggcu

SEQ ID NO: 4249 - RNA, 22 nt, Human herpesvirus 4
cagaugaaauuuaccaccccuu

SEQ ID NO: 4250 - RNA, 22 nt, Human herpesvirus 4
agcaccauggggaaaacaaugu

SEQ ID NO: 4251 - RNA, 20 nt, Human herpesvirus 4
cucuaacuucacgguggcau

SEQ ID NO: 4252 - RNA, 22 nt, Human herpesvirus 4
ugcugacccgcugcgucauauu

SEQ ID NO: 4253 - RNA, 22 nt, Human herpesvirus 4
gcuauagacgguugggcaguag

SEQ ID NO: 4254 - RNA, 22 nt, Human herpesvirus 4
gacugaaggcaucucuuagguc

SEQ ID NO: 4255 - RNA, 20 nt, Human herpesvirus 4
ggaaaauugucacauugguc

SEQ ID NO: 4256 - RNA, 22 nt, Human herpesvirus 4
uggauagaggguggugaucuug

SEQ ID NO: 4257 - RNA, 22 nt, Human herpesvirus 4
gagcacacacccacucuaucua

SEQ ID NO: 4258 - RNA, 22 nt, Human herpesvirus 4
uuucaagagcugaaccagaaua

SEQ ID NO: 4259 - RNA, 22 nt, Human herpesvirus 4
uuucgggaggcucaaagaaguu

SEQ ID NO: 4260 - RNA, 22 nt, Human herpesvirus 4
uuugagaauuccaaguacauca

SEQ ID NO: 4261 - RNA, 21 nt, Human herpesvirus 4
uacccagacccugagcucgga

SEQ ID NO: 4262 - RNA, 22 nt, Human herpesvirus 4
ucuguaccguagacugccgugg

SEQ ID NO: 4263 - RNA, 15 nt, Human herpesvirus 4
agggcacagauagac

SEQ ID NO: 4264 - RNA, 22 nt, Human herpesvirus 4
acuacuagaccaugacuuugua

SEQ ID NO: 4265 - RNA, 22 nt, Human herpesvirus 4
ucaacuccagggucuagcaccu

SEQ ID NO: 4266 - RNA, 22 nt, Human herpesvirus 4
caccuggugacuaguggugcgc

SEQ ID NO: 4267 - RNA, 22 nt, Human herpesvirus 4
cacaacacuaacacuagguucc

SEQ ID NO: 4268 - RNA, 22 nt, Human herpesvirus 4
uccagggggcagccgcggccca

SEQ ID NO: 4269 - RNA, 22 nt, Human herpesvirus 4
gaccgcggccgagccaccaggg

SEQ ID NO: 4270 - RNA, 22 nt, Human herpesvirus 4
gagggcagacggaugucagguc

SEQ ID NO: 4271 - RNA, 20 nt, Human herpesvirus 4
cccggagacugguggcccuc

SEQ ID NO: 4272 - RNA, 22 nt, Human herpesvirus 4
aaauguccccuuucuaugacgg

SEQ ID NO: 4273 - RNA, 22 nt, Human herpesvirus 4
uuccaugagcgggcagacuccu

SEQ ID NO: 4274 - RNA, 22 nt, Human herpesvirus 4
agguagauaaccuuuugcucaa

SEQ ID NO: 4275 - RNA, 13 nt, Human herpesvirus 4
uuaagggcuaccu

SEQ ID NO: 4276 - RNA, 22 nt, Human herpesvirus 4
ggcugucgaaggucaccguucc

SEQ ID NO: 4277 - RNA, 22 nt, Human herpesvirus 4
ggggaagagcacaugcagccug

SEQ ID NO: 4278 - RNA, 22 nt, Human herpesvirus 4
gcgggcccaggccaugcacaug

SEQ ID NO: 4279 - RNA, 17 nt, Human herpesvirus 4
cgguggccugaguccgc

SEQ ID NO: 4280 - RNA, 22 nt, Human herpesvirus 4
ugccucagaauacuaacagcua

SEQ ID NO: 4281 - RNA, 19 nt, Human herpesvirus 4
ucuaucaguaaacgggcag

SEQ ID NO: 4282 - RNA, 22 nt, Human herpesvirus 4
cccuggccacuauucucuucuu

SEQ ID NO: 4283 - RNA, 22 nt, Human herpesvirus 4
gaaagaugcagugauucaggag

SEQ ID NO: 4284 - RNA, 22 nt, Human herpesvirus 4
ucaccccccgcaggaccaccgg

SEQ ID NO: 4285 - RNA, 22 nt, Human herpesvirus 4
ucgggucccaagcaggggauga

SEQ ID NO: 4286 - RNA, 22 nt, Human herpesvirus 4
acgccgcucguggaccacgcca

SEQ ID NO: 4287 - RNA, 22 nt, Human herpesvirus 4
uuguguggcugacggugccgug

SEQ ID NO: 4288 - RNA, 22 nt, Human herpesvirus 4
ugcagcugagacuccauggagc

SEQ ID NO: 4289 - RNA, 22 nt, Human herpesvirus 4
agcucccucuccuucucuaggc

SEQ ID NO: 4290 - RNA, 22 nt, Human herpesvirus 4
gaacuccagcggcgggaccugg

SEQ ID NO: 4291 - RNA, 22 nt, Human herpesvirus 4
gguacucuccgacauugccgcc

SEQ ID NO: 4292 - RNA, 22 nt, Human herpesvirus 4
cagcagcagcagaagggucagc

SEQ ID NO: 4293 - RNA, 20 nt, Human herpesvirus 4
cccacugcaguacuagcaug

SEQ ID NO: 4294 - RNA, 22 nt, Human herpesvirus 4
gagagccagugggggggguguu

SEQ ID NO: 4295 - RNA, 21 nt, Human herpesvirus 4
cguucugcgccagcucuugac

SEQ ID NO: 4296 - RNA, 22 nt, Human herpesvirus 4
ugaguccaaacagcuaauuucu

SEQ ID NO: 4297 - RNA, 20 nt, Human herpesvirus 4
gucaccgcgaccaagacuca

SEQ ID NO: 4298 - RNA, 22 nt, Human herpesvirus 4
gcguggcacagcagcccggggu

SEQ ID NO: 4299 - RNA, 20 nt, Human herpesvirus 4
cugccgcuggcggacuacgc

SEQ ID NO: 4300 - RNA, 22 nt, Human herpesvirus 4
gguugucacgcugccagugacc

SEQ ID NO: 4301 - RNA, 15 nt, Human herpesvirus 4
ucaacggcaacaacc

SEQ ID NO: 4302 - RNA, 22 nt, Human herpesvirus 4
gagccucaggaggguccccucc

SEQ ID NO: 4303 - RNA, 18 nt, Human herpesvirus 4
agggggaggaucgggcuc

SEQ ID NO: 4304 - RNA, 22 nt, Human herpesvirus 4
agcccaggggucucgugcaggu

SEQ ID NO: 4305 - RNA, 22 nt, Human herpesvirus 4
ugaucaccgcccacccccguuu

SEQ ID NO: 4306 - RNA, 22 nt, Human herpesvirus 4
ccccgcccaugucagagucagc

SEQ ID NO: 4307 - RNA, 19 nt, Human herpesvirus 4
cauccugcaguacgugggg

SEQ ID NO: 4308 - RNA, 22 nt, Human herpesvirus 4
ccucccuggugccugaagaccc

SEQ ID NO: 4309 - RNA, 22 nt, Human herpesvirus 4
ugggcccucuucuacggcccca

SEQ ID NO: 4310 - RNA, 22 nt, Human herpesvirus 4
uguccuguuagcuggugcgguu

SEQ ID NO: 4311 - RNA, 22 nt, Human herpesvirus 4
gacgccaaugcuaacuccccaa

SEQ ID NO: 4312 - RNA, 22 nt, Human herpesvirus 4
ugccggcuacccggagaguuuc

SEQ ID NO: 4313 - RNA, 13 nt, Human herpesvirus 4
ccuggguccggca

SEQ ID NO: 4314 - RNA, 22 nt, Human herpesvirus 4
ugaguagagcuggguagaccug

SEQ ID NO: 4315 - RNA, 19 nt, Human herpesvirus 4
gcaaauccaguuguauuca

SEQ ID NO: 4316 - RNA, 22 nt, Human herpesvirus 4
gaccugaugcugcuggugugcu

SEQ ID NO: 4317 - RNA, 22 nt, Human herpesvirus 4
acaucacguaggcaccaggugu

SEQ ID NO: 4318 - RNA, 22 nt, Human herpesvirus 4
cacacgcccccauuucuaaagu

SEQ ID NO: 4319 - RNA, 22 nt, Human herpesvirus 4
acacauucccggggaaggugug

SEQ ID NO: 4320 - RNA, 22 nt, Human herpesvirus 4
ucgacggcugcggcggcggagg

SEQ ID NO: 4321 - RNA, 22 nt, Human herpesvirus 4
ccgaagucgcggcccggaggcu

SEQ ID NO: 4322 - RNA, 22 nt, Human herpesvirus 4
ugucauggugaggcaggcaagg

SEQ ID NO: 4323 - RNA, 19 nt, Human herpesvirus 4
uuaguggcucaaagugaug

SEQ ID NO: 4324 - RNA, 22 nt, Human herpesvirus 4
uccucggggcagggguggcuag

SEQ ID NO: 4325 - RNA, 22 nt, Human herpesvirus 4
gggcaggccgcaggcagaggac

SEQ ID NO: 4326 - RNA, 22 nt, Human herpesvirus 4
aggcuggacuuuacagacagug

SEQ ID NO: 4327 - RNA, 22 nt, Human herpesvirus 4
ucaggcuggggggagaaaagcu

SEQ ID NO: 4328 - RNA, 22 nt, Human herpesvirus 4
aggcuggacuuuacagacagug

SEQ ID NO: 4329 - RNA, 22 nt, Human herpesvirus 4
ucaggcuggggggagaaaagcu

SEQ ID NO: 4330 - RNA, 22 nt, Human herpesvirus 4
aggcuggacuuuacagacagug

SEQ ID NO: 4331 - RNA, 22 nt, Human herpesvirus 4
ucaggcuggggggagaaaagcu

SEQ ID NO: 4332 - RNA, 22 nt, Human herpesvirus 4
aggcuggacuuuacagacagug

SEQ ID NO: 4333 - RNA, 22 nt, Human herpesvirus 4
ucaggcuggggggagaaaagcu

SEQ ID NO: 4334 - RNA, 22 nt, Human herpesvirus 4
aggcuggacuuuacagacagug

SEQ ID NO: 4335 - RNA, 22 nt, Human herpesvirus 4
ucaggcuggggggagaaaagcu

SEQ ID NO: 4336 - RNA, 22 nt, Human herpesvirus 4
aggcuggacuuuacagacagug

SEQ ID NO: 4337 - RNA, 22 nt, Human herpesvirus 4
ucaggcuggggggagaaaagcu

SEQ ID NO: 4338 - RNA, 22 nt, Human herpesvirus 4
aggcuggacuuuacagacagug

SEQ ID NO: 4339 - RNA, 22 nt, Human herpesvirus 4
ucaggcuggggggagaaaagcu

SEQ ID NO: 4340 - RNA, 22 nt, Human herpesvirus 4
gcgaccggugccuucuuaggag

SEQ ID NO: 4341 - RNA, 18 nt, Human herpesvirus 4
ugagacgggugggugugu

SEQ ID NO: 4342 - RNA, 22 nt, Human herpesvirus 4
acacccgugcuugucuugcagc

SEQ ID NO: 4343 - RNA, 22 nt, Human herpesvirus 4
uguugggaugggagagggugau

SEQ ID NO: 4344 - RNA, 22 nt, Human herpesvirus 4
uggcgaguuugcguccucagaa

SEQ ID NO: 4345 - RNA, 20 nt, Human herpesvirus 4
cugaauagguagcauuguca

SEQ ID NO: 4346 - RNA, 22 nt, Human herpesvirus 4
gccaggugggcccuggccacgg

SEQ ID NO: 4347 - RNA, 22 nt, Human herpesvirus 4
cacccucagaaggcgccuccug

SEQ ID NO: 4348 - RNA, 22 nt, Human herpesvirus 4
ccugauugcugagaaccugcug

SEQ ID NO: 4349 - RNA, 15 nt, Human herpesvirus 4
ggccucagcgucagg

SEQ ID NO: 4350 - RNA, 22 nt, Human herpesvirus 4
gcuucaccugcccaagaagcgg

SEQ ID NO: 4351 - RNA, 22 nt, Human herpesvirus 4
cgcugcggccugguucugacgc

SEQ ID NO: 4352 - RNA, 22 nt, Human herpesvirus 4
ucagguggccgugcuaugcgcc

SEQ ID NO: 4353 - RNA, 20 nt, Human herpesvirus 4
ggccaugaaagccuccuggc

SEQ ID NO: 4354 - RNA, 22 nt, Human herpesvirus 4
agccaacuccaugguuauguac

SEQ ID NO: 4355 - RNA, 22 nt, Human herpesvirus 4
uacagaaccaaagagguggccc

SEQ ID NO: 4356 - RNA, 22 nt, Human herpesvirus 4
agaugcucuugccuagauacag

SEQ ID NO: 4357 - RNA, 20 nt, Human herpesvirus 4
ugaggggagguggggugucu

SEQ ID NO: 4358 - RNA, 22 nt, Human herpesvirus 4
uagaauaaacugagaacaguca

SEQ ID NO: 4359 - RNA, 22 nt, Human herpesvirus 4
ugucucucgcgugauuuccaua

SEQ ID NO: 4360 - RNA, 22 nt, Human herpesvirus 4
ccaucuuccccgaggucagaaa

SEQ ID NO: 4361 - RNA, 20 nt, Human herpesvirus 4
aggucccgggcuucggaugg

SEQ ID NO: 4362 - RNA, 22 nt, Human herpesvirus 4
ucugcaugguggcgggugccca

SEQ ID NO: 4363 - RNA, 22 nt, Human herpesvirus 4
gcaggacccguugguguaggcu

SEQ ID NO: 4364 - RNA, 22 nt, Human herpesvirus 4
gcaggguccaagguugugcugu

SEQ ID NO: 4365 - RNA, 20 nt, Human herpesvirus 4
cauuagcaagaacccccugc

SEQ ID NO: 4366 - RNA, 22 nt, Human herpesvirus 4
uacuggacccugaauuggaaac

SEQ ID NO: 4367 - RNA, 22 nt, Human herpesvirus 4
uaacacuucaugggucccguag

SEQ ID NO: 4368 - RNA, 22 nt, Human herpesvirus 4
ucauugauuacuucaccuuuca

SEQ ID NO: 4369 - RNA, 21 nt, Human herpesvirus 4
aggugaccaacauugaugaca

SEQ ID NO: 4370 - RNA, 22 nt, Human herpesvirus 4
cagcguguuuugggucuugaug

SEQ ID NO: 4371 - RNA, 22 nt, Human herpesvirus 4
ucuaggauuuugauguuguugc

SEQ ID NO: 4372 - RNA, 22 nt, Human herpesvirus 4
uaagaggacgcaggcauacaag

SEQ ID NO: 4373 - RNA, 22 nt, Human herpesvirus 4
uguaugccugguguccccuuag

SEQ ID NO: 4374 - RNA, 22 nt, Human herpesvirus 4
uuacgguuuccuagauuguaca

SEQ ID NO: 4375 - RNA, 22 nt, Human herpesvirus 4
ucacaaucuauggggucguaga

SEQ ID NO: 4376 - RNA, 22 nt, Human herpesvirus 4
cccgcaguuguagacugucauu

SEQ ID NO: 4377 - RNA, 21 nt, Human herpesvirus 4
ugggcgguccacacgcgcggg

SEQ ID NO: 4378 - RNA, 22 nt, Human herpesvirus 4
ugggcacugugucacccuugcc

SEQ ID NO: 4379 - RNA, 20 nt, Human herpesvirus 4
cucaguuccccgcaggccca

SEQ ID NO: 4380 - RNA, 22 nt, Human herpesvirus 4
ccacgagccgcuucgcccgugu

SEQ ID NO: 4381 - RNA, 22 nt, Human herpesvirus 4
ccugcgggcggaggccgaggcc

SEQ ID NO: 4382 - RNA, 22 nt, Human herpesvirus 4
cgcacucgaggcccugaugcuc

SEQ ID NO: 4383 - RNA, 22 nt, Human herpesvirus 4
ccgccaaccuggccgaggcggc

SEQ ID NO: 4384 - RNA, 22 nt, Human herpesvirus 4
gggguaguagguuuugggaggg

SEQ ID NO: 4385 - RNA, 18 nt, Human herpesvirus 4
ucaacugccacagacccc

SEQ ID NO: 4386 - RNA, 22 nt, Human herpesvirus 4
acggcuguuagaaugugcacgg

SEQ ID NO: 4387 - RNA, 22 nt, Human herpesvirus 4
ucguccaccacgaucacauugg

SEQ ID NO: 4388 - RNA, 22 nt, Human herpesvirus 4
ggguaaaugcaccuugacugua

SEQ ID NO: 4389 - RNA, 22 nt, Human herpesvirus 4
uguaccugaugagucacacccc

SEQ ID NO: 4390 - RNA, 22 nt, Human herpesvirus 4
ucaaccucuucaggcccggggu

SEQ ID NO: 4391 - RNA, 22 nt, Human herpesvirus 4
cuccggggcugaucagguuaau

SEQ ID NO: 4392 - RNA, 22 nt, Human herpesvirus 4
caugaaccugggaccuauugau

SEQ ID NO: 4393 - RNA, 21 nt, Human herpesvirus 4
ugagaccccagagucaggcug

SEQ ID NO: 4394 - RNA, 22 nt, Human herpesvirus 4
ccccgacaucgccgccccaggg

SEQ ID NO: 4395 - RNA, 22 nt, Human herpesvirus 4
ucgaguccggggagaacggugg

SEQ ID NO: 4396 - RNA, 22 nt, Human herpesvirus 4
cgaagacgaggagucugagcgu

SEQ ID NO: 4397 - RNA, 19 nt, Human herpesvirus 4
cucgauuccagcuuccaag

SEQ ID NO: 4398 - RNA, 22 nt, Human herpesvirus 4
ggaggagcccaugcagcacuag

SEQ ID NO: 4399 - RNA, 22 nt, Human herpesvirus 4
ucgucguucaggaacagccucc

SEQ ID NO: 4400 - RNA, 22 nt, Human herpesvirus 4
gcuccaggggccaggggauacc

SEQ ID NO: 4401 - RNA, 20 nt, Human herpesvirus 4
cggugcccagguagaggagc

SEQ ID NO: 4402 - RNA, 22 nt, Human herpesvirus 4
ugaaaauaagccacgucugccg

SEQ ID NO: 4403 - RNA, 22 nt, Human herpesvirus 4
guggccugcuggccguggcaga

SEQ ID NO: 4404 - RNA, 22 nt, Human herpesvirus 4
gacggcgggggagguuuccuca

SEQ ID NO: 4405 - RNA, 22 nt, Human herpesvirus 4
aggaucccaugcccccgcgguu

SEQ ID NO: 4406 - RNA, 22 nt, Human herpesvirus 4
gcuccauugcccgcuccccgcc

SEQ ID NO: 4407 - RNA, 22 nt, Human herpesvirus 4
cuuggcuggcgcggccgggggc

SEQ ID NO: 4408 - RNA, 22 nt, Human herpesvirus 4
ccugccgcggggccuccugccg

SEQ ID NO: 4409 - RNA, 20 nt, Human herpesvirus 4
gcggggccuccugccgcggg

SEQ ID NO: 4410 - RNA, 22 nt, Human herpesvirus 4
gccgccgagagauaaggggggu

SEQ ID NO: 4411 - RNA, 22 nt, Human herpesvirus 4
cuccgccucuccucugucuggg

SEQ ID NO: 4412 - RNA, 22 nt, Human herpesvirus 4
uggacgcgcgaccugcuacucu

SEQ ID NO: 4413 - RNA, 16 nt, Human herpesvirus 4
ggagcgucgccucugg

SEQ ID NO: 4414 - RNA, 22 nt, Human herpesvirus 4
cgucagcucaagacucgaauuu

SEQ ID NO: 4415 - RNA, 22 nt, Human herpesvirus 4
augcucgguaaugagauagaua

SEQ ID NO: 4416 - RNA, 22 nt, Human herpesvirus 4
uggaucaggccguuauugagac

SEQ ID NO: 4417 - RNA, 20 nt, Human herpesvirus 4
ccuaugacacugccuaucca

SEQ ID NO: 4418 - RNA, 22 nt, Human herpesvirus 4
acgcagccuccggguccgugca

SEQ ID NO: 4419 - RNA, 22 nt, Human herpesvirus 4
ggacagggccgaggagggcugg

SEQ ID NO: 4420 - RNA, 22 nt, Human herpesvirus 4
gccuccgacuaccucccggaga

SEQ ID NO: 4421 - RNA, 20 nt, Human herpesvirus 4
cccggccugguguuugaggu

SEQ ID NO: 4422 - RNA, 22 nt, Human herpesvirus 4
cccggagacaacaaauuuaaca

SEQ ID NO: 4423 - RNA, 22 nt, Human herpesvirus 4
cgagagccauguucccagcggc

SEQ ID NO: 4424 - RNA, 22 nt, Human herpesvirus 4
caggucacuaaagugcuucagg

SEQ ID NO: 4425 - RNA, 21 nt, Human herpesvirus 4
ucuguaccguagacugccgug

SEQ ID NO: 4426 - RNA, 22 nt, Human herpesvirus 4
aaccgcgggggcaugggauccu

SEQ ID NO: 4427 - RNA, 22 nt, Human herpesvirus 4
ugaggaaaccucccccgccguc

SEQ ID NO: 4428 - RNA, 22 nt, Human herpesvirus 4
uccccauucuccuucuccuccu

SEQ ID NO: 4429 - RNA, 16 nt, Human herpesvirus 4
gacgagggagagggag

SEQ ID NO: 4430 - RNA, 22 nt, Human herpesvirus 4
caucauuagauggggggacuuu

SEQ ID NO: 4431 - RNA, 22 nt, Human herpesvirus 4
uuggcucucauuguacauaugu

SEQ ID NO: 4432 - RNA, 22 nt, Human herpesvirus 4
ugugaggguccagaggcccgug

SEQ ID NO: 4433 - RNA, 22 nt, Human herpesvirus 4
gccagccuggccccccacgugu

SEQ ID NO: 4434 - RNA, 22 nt, Human herpesvirus 4
gcccgcggccauugggcccaga

SEQ ID NO: 4435 - RNA, 22 nt, Human herpesvirus 4
uccaggggcccgagguuggagc

SEQ ID NO: 4436 - RNA, 22 nt, Human herpesvirus 4
uacucacgggacgaacagcgug

SEQ ID NO: 4437 - RNA, 22 nt, Human herpesvirus 4
agggcaucuuccgggaguacaa

SEQ ID NO: 4438 - RNA, 22 nt, Human herpesvirus 4
cuccaaugaggccacuguaaac

SEQ ID NO: 4439 - RNA, 22 nt, Human herpesvirus 4
gguagccgacgguggcuaaccu

SEQ ID NO: 4440 - RNA, 22 nt, Human herpesvirus 4
ucuccuucccgccucccacccg

SEQ ID NO: 4441 - RNA, 22 nt, Human herpesvirus 4
gccuccccaccggguccaucag

SEQ ID NO: 4442 - RNA, 22 nt, Human herpesvirus 4
ucuccuucccgccucccacccg

SEQ ID NO: 4443 - RNA, 22 nt, Human herpesvirus 4
gccuccccaccggguccaucag

SEQ ID NO: 4444 - RNA, 22 nt, Human herpesvirus 4
uaugcauacagccugcgucuga

SEQ ID NO: 4445 - RNA, 22 nt, Human herpesvirus 4
acgauuucuuggcaauaacagu

SEQ ID NO: 4446 - RNA, 22 nt, Human herpesvirus 4
ugccgguugccauuuuucaagc

SEQ ID NO: 4447 - RNA, 20 nt, Human herpesvirus 4
guggcagcaggccuaagaag

SEQ ID NO: 4448 - RNA, 22 nt, Human herpesvirus 4
gugcuagacccuggaguugaac

SEQ ID NO: 4449 - RNA, 22 nt, Human herpesvirus 4
uacaaagucauggucuaguagu

SEQ ID NO: 4450 - RNA, 22 nt, Human herpesvirus 4
ucgugugauaaugagugucuug

SEQ ID NO: 4451 - RNA, 22 nt, Human herpesvirus 4
gagacaguaaugucaaaugucc

SEQ ID NO: 4452 - RNA, 22 nt, Human herpesvirus 4
guggccgggacuguuucguugg

SEQ ID NO: 4453 - RNA, 22 nt, Human herpesvirus 4
uuggcugaaccaccggccaugg

SEQ ID NO: 4454 - RNA, 22 nt, Human herpesvirus 4
ucaugaccuggccugugccuug

SEQ ID NO: 4455 - RNA, 21 nt, Human herpesvirus 4
augucccuccagcgugguggc

SEQ ID NO: 4456 - RNA, 22 nt, Human herpesvirus 4
gguuugcccaacucuuauucuu

SEQ ID NO: 4457 - RNA, 20 nt, Human herpesvirus 4
agaaugauggugggggaacc

SEQ ID NO: 4458 - RNA, 22 nt, Human herpesvirus 4
uggggugguguagguaugggau

SEQ ID NO: 4459 - RNA, 22 nt, Human herpesvirus 4
uacgccuaaaggcgcaguccgc

SEQ ID NO: 4460 - RNA, 22 nt, Human herpesvirus 4
uccgggugggcaggcaguacga

SEQ ID NO: 4461 - RNA, 22 nt, Human herpesvirus 4
ugucuuuccucccaccccuguc

SEQ ID NO: 4462 - RNA, 22 nt, Human herpesvirus 4
gggccgccuguguggucuccug

SEQ ID NO: 4463 - RNA, 19 nt, Human herpesvirus 4
ggagguugccgaggggcuc

SEQ ID NO: 4464 - RNA, 22 nt, Human herpesvirus 4
ccuggggccguagaagagggcc

SEQ ID NO: 4465 - RNA, 20 nt, Human herpesvirus 4
gugggucuucaggcaccagg

SEQ ID NO: 4466 - RNA, 22 nt, Human herpesvirus 4
ggggggcggcggcuccugguau

SEQ ID NO: 4467 - RNA, 21 nt, Human herpesvirus 4
ccuggggggccggcggcuccu

SEQ ID NO: 4468 - RNA, 22 nt, Human herpesvirus 4
gaaaacgacgcuggggagaugg

SEQ ID NO: 4469 - RNA, 22 nt, Human herpesvirus 4
ccaaccgcuaccccugggcggc

SEQ ID NO: 4470 - RNA, 22 nt, Human herpesvirus 4
gaugugauaacggggaaugugu

SEQ ID NO: 4471 - RNA, 21 nt, Human herpesvirus 4
ccggggcccacgugaacaucc

SEQ ID NO: 4472 - RNA, 22 nt, Human herpesvirus 4
cgcgggcgguggagucggcagc

SEQ ID NO: 4473 - RNA, 19 nt, Human herpesvirus 4
caccuccucccuuacugcg

SEQ ID NO: 4474 - RNA, 22 nt, Human herpesvirus 4
ggugcaugauggauggugagua

SEQ ID NO: 4475 - RNA, 22 nt, Human herpesvirus 4
uucaugaucugacaguggccgc

SEQ ID NO: 4476 - RNA, 22 nt, Human herpesvirus 4
gacgcgguggaggcgcugaagg

SEQ ID NO: 4477 - RNA, 22 nt, Human herpesvirus 4
cuucacggcgcacccccaguac

SEQ ID NO: 4478 - RNA, 22 nt, Human herpesvirus 4
gguuggguacaaaguaguugug

SEQ ID NO: 4479 - RNA, 21 nt, Human herpesvirus 4
ugcacaaagguuguaacaauc

SEQ ID NO: 4480 - RNA, 22 nt, Human herpesvirus 4
agggaggcggcggccggaggug

SEQ ID NO: 4481 - RNA, 21 nt, Human herpesvirus 4
ggcuaucuuugcccaaucccu

SEQ ID NO: 4482 - RNA, 22 nt, Human herpesvirus 4
ugggcagcaggccuacuucuac

SEQ ID NO: 4483 - RNA, 22 nt, Human herpesvirus 4
uggacguggaguuugcaguccu

SEQ ID NO: 4484 - RNA, 22 nt, Human herpesvirus 4
ugcuacuggcuuucguccucug

SEQ ID NO: 4485 - RNA, 22 nt, Human herpesvirus 4
ggggccuagguacucuuggugc

SEQ ID NO: 4486 - RNA, 22 nt, Human herpesvirus 4
ucucugacuaggcucugauuuu

SEQ ID NO: 4487 - RNA, 22 nt, Human herpesvirus 4
aucuagagucgaguuccaguuu

SEQ ID NO: 4488 - RNA, 22 nt, Human herpesvirus 4
ugugugaacagugauuucagua

SEQ ID NO: 4489 - RNA, 17 nt, Human herpesvirus 4
uggugucacuuccgcau

SEQ ID NO: 4490 - RNA, 22 nt, Human herpesvirus 4
cggagggucucagaggaucgcc

SEQ ID NO: 4491 - RNA, 22 nt, Human herpesvirus 4
ccgggcgaucccccuccacuuc

SEQ ID NO: 4492 - RNA, 22 nt, Human herpesvirus 4
gggagcgccaauuuguacaucc

SEQ ID NO: 4493 - RNA, 22 nt, Human herpesvirus 4
uagcccacccuugugucucccu

SEQ ID NO: 4494 - RNA, 22 nt, Human herpesvirus 4
ccgcuucagcugggcagcaugc

SEQ ID NO: 4495 - RNA, 21 nt, Human herpesvirus 4
uaaacucgcgcccaugggcgg

SEQ ID NO: 4496 - RNA, 22 nt, Human herpesvirus 4
uaagcuacuaugacuaaccuuu

SEQ ID NO: 4497 - RNA, 22 nt, Human herpesvirus 4
gcauuaccaugucauaggcuug

SEQ ID NO: 4498 - RNA, 22 nt, Human herpesvirus 4
ucuguagaggaagugguugcgc

SEQ ID NO: 4499 - RNA, 20 nt, Human herpesvirus 4
uagaccacguccccccagac

SEQ ID NO: 4500 - RNA, 22 nt, Human herpesvirus 4
cccgauauucuaccugugguaa

SEQ ID NO: 4501 - RNA, 20 nt, Human herpesvirus 4
ugccauugagucccuuuggg

SEQ ID NO: 4502 - RNA, 22 nt, Human herpesvirus 4
gagcaucggcaagauuuugaca

SEQ ID NO: 4503 - RNA, 22 nt, Human herpesvirus 4
uggucucaugccccugcuuucg

SEQ ID NO: 4504 - RNA, 22 nt, Human herpesvirus 4
uacgaccccauagauugugaca

SEQ ID NO: 4505 - RNA, 22 nt, Human herpesvirus 4
uacaaucuaggaaaccguaauc

SEQ ID NO: 4506 - RNA, 22 nt, Human herpesvirus 4
gcuccucuaccugggcaccgcc

SEQ ID NO: 4507 - RNA, 22 nt, Human herpesvirus 4
gguauccccuggccccuggagc

SEQ ID NO: 4508 - RNA, 22 nt, Human herpesvirus 4
uugcauuuugggggggcgugcc

SEQ ID NO: 4509 - RNA, 17 nt, Human herpesvirus 4
ucccccgguuuugugga

SEQ ID NO: 4510 - RNA, 22 nt, Human herpesvirus 4
uggucuuuuuacaaacucauau

SEQ ID NO: 4511 - RNA, 22 nt, Human herpesvirus 4
ugaaggaugcgauuaaggaccu

SEQ ID NO: 4512 - RNA, 22 nt, Human herpesvirus 4
aaccuaguguuaguguugugcu

SEQ ID NO: 4513 - RNA, 22 nt, Human herpesvirus 4
cgcaccacuagucaccaggugu

SEQ ID NO: 4514 - RNA, 22 nt, Human herpesvirus 4
ccgguuugggcacuggaggugg

SEQ ID NO: 4515 - RNA, 13 nt, Human herpesvirus 4
gcaucuccaccgg

SEQ ID NO: 4516 - RNA, 22 nt, Human herpesvirus 4
uggaagucuuggcggcguuggu

SEQ ID NO: 4517 - RNA, 22 nt, Human herpesvirus 4
cagcgaucccugagaacgcucc

SEQ ID NO: 4518 - RNA, 22 nt, Human herpesvirus 4
uacaacaacaccuacgaggccc

SEQ ID NO: 4519 - RNA, 12 nt, Human herpesvirus 4
ccguugucgugu

SEQ ID NO: 4520 - RNA, 22 nt, Human herpesvirus 4
agggaugcguggcaucuccccg

SEQ ID NO: 4521 - RNA, 22 nt, Human herpesvirus 4
guggacaggcucgacaaaguuc

SEQ ID NO: 4522 - RNA, 22 nt, Human herpesvirus 4
agauacagcacgacggcggagu

SEQ ID NO: 4523 - RNA, 21 nt, Human herpesvirus 4
ccacccgccgcuuucuggucu

SEQ ID NO: 4524 - RNA, 22 nt, Human herpesvirus 4
ugacuacugggacuccugggcc

SEQ ID NO: 4525 - RNA, 22 nt, Human herpesvirus 4
cucuuucacgacuucccccccu

SEQ ID NO: 4526 - RNA, 22 nt, Human herpesvirus 4
ucaaggggcacgagauggccca

SEQ ID NO: 4527 - RNA, 21 nt, Human herpesvirus 4
gcccagcuccgugguccugag

SEQ ID NO: 4528 - RNA, 22 nt, Human herpesvirus 4
ggucacucugcagugccuggug

SEQ ID NO: 4529 - RNA, 22 nt, Human herpesvirus 4
ccuggcaccugaguguggaggu

SEQ ID NO: 4530 - RNA, 22 nt, Human herpesvirus 4
uccaagagaaugacagcaagga

SEQ ID NO: 4531 - RNA, 22 nt, Human herpesvirus 4
ucccugaaauccauuuacuggg

SEQ ID NO: 4532 - RNA, 22 nt, Human herpesvirus 4
ggggagcacuacugcugaaucu

SEQ ID NO: 4533 - RNA, 20 nt, Human herpesvirus 4
ucccagcccacagagccccc

SEQ ID NO: 4534 - RNA, 22 nt, Human herpesvirus 4
ugacagcuacgaaacugaccag

SEQ ID NO: 4535 - RNA, 22 nt, Human herpesvirus 4
uaccagugcuacaacgcgguca

SEQ ID NO: 4536 - RNA, 22 nt, Human herpesvirus 4
ccgcaaaggccaaagggagaca

SEQ ID NO: 4537 - RNA, 22 nt, Human herpesvirus 4
gggcuaacucuauggccagagc

SEQ ID NO: 4538 - RNA, 22 nt, Human herpesvirus 4
uggaacacccugcuggccuccc

SEQ ID NO: 4539 - RNA, 22 nt, Human herpesvirus 4
cagcagcggcggcaguagccag

SEQ ID NO: 4540 - RNA, 22 nt, Human herpesvirus 4
uggccaccguucuccccggacu

SEQ ID NO: 4541 - RNA, 22 nt, Human herpesvirus 4
uggggcggcgaugucggggcug

SEQ ID NO: 4542 - RNA, 22 nt, Human herpesvirus 4
agccccccagaguggcuaaagg

SEQ ID NO: 4543 - RNA, 22 nt, Human herpesvirus 4
ugugcaccaacuuuaggagccu

SEQ ID NO: 4544 - RNA, 22 nt, Human herpesvirus 4
uccgagugggacgugacccagg

SEQ ID NO: 4545 - RNA, 22 nt, Human herpesvirus 4
uggggcgcuaccucuuucagcg

SEQ ID NO: 4546 - RNA, 22 nt, Human herpesvirus 4
ccccacguacugcaggaugucg

SEQ ID NO: 4547 - RNA, 20 nt, Human herpesvirus 4
ugacucugacaugggcgggg

SEQ ID NO: 4548 - RNA, 22 nt, Human herpesvirus 4
uaccacaagcuccggcugcccg

SEQ ID NO: 4549 - RNA, 20 nt, Human herpesvirus 4
gcccuggccguggccaggua

SEQ ID NO: 4550 - RNA, 22 nt, Human herpesvirus 4
cccaacaaagauuguuagugga

SEQ ID NO: 4551 - RNA, 19 nt, Human herpesvirus 4
ugacaguuguuccugguag

SEQ ID NO: 4552 - RNA, 22 nt, Human herpesvirus 4
ggguaccagacgucuuguaaau

SEQ ID NO: 4553 - RNA, 20 nt, Human herpesvirus 4
uaagcauagacgccaaaucu

SEQ ID NO: 4554 - RNA, 22 nt, Human herpesvirus 4
uaguaggguccagucucaggcc

SEQ ID NO: 4555 - RNA, 22 nt, Human herpesvirus 4
ucuuagaaugguggccgggcug

SEQ ID NO: 4556 - RNA, 22 nt, Human herpesvirus 4
accaagagagcaagaaagauac

SEQ ID NO: 4557 - RNA, 20 nt, Human herpesvirus 4
agguacgcuuccuucguggu

SEQ ID NO: 4558 - RNA, 22 nt, Human herpesvirus 4
ccugaugucacaggggccgucu

SEQ ID NO: 4559 - RNA, 20 nt, Human herpesvirus 4
gcgcagcuuggacucgcagg

SEQ ID NO: 4560 - RNA, 22 nt, Human herpesvirus 4
uacgggacccaugaaguguuac

SEQ ID NO: 4561 - RNA, 22 nt, Human herpesvirus 4
uuuccaauucaggguccaguac

SEQ ID NO: 4562 - RNA, 22 nt, Human herpesvirus 4
ucugauaaaugaccucuugcau

SEQ ID NO: 4563 - RNA, 15 nt, Human herpesvirus 4
uguaggauggguaga

SEQ ID NO: 4564 - RNA, 22 nt, Human herpesvirus 4
auccgccaggaccuggaugcug

SEQ ID NO: 4565 - RNA, 22 nt, Human herpesvirus 4
caugcaggucaggucccccucc

SEQ ID NO: 4566 - RNA, 22 nt, Human herpesvirus 4
cgcgcuugacgggggcagcuug

SEQ ID NO: 4567 - RNA, 21 nt, Human herpesvirus 4
gcccgcuccuguacgacgcag

SEQ ID NO: 4568 - RNA, 22 nt, Human herpesvirus 4
aaugcagguuugacuucauaug

SEQ ID NO: 4569 - RNA, 20 nt, Human herpesvirus 4
acgucaacuuuacuuuuauu

SEQ ID NO: 4570 - RNA, 22 nt, Human herpesvirus 4
ggaccggcaguaugccucgacg

SEQ ID NO: 4571 - RNA, 22 nt, Human herpesvirus 4
gggccgccgccaccgcugccgu

SEQ ID NO: 4572 - RNA, 22 nt, Human herpesvirus 4
gagccuagagguagguauccau

SEQ ID NO: 4573 - RNA, 21 nt, Human herpesvirus 4
uccuggagguauccuaagcuc

SEQ ID NO: 4574 - RNA, 22 nt, Human herpesvirus 4
aaaguugugccgcaggaaggag

SEQ ID NO: 4575 - RNA, 22 nt, Human herpesvirus 4
cgucagaauguaccagaagaug

SEQ ID NO: 4576 - RNA, 22 nt, Human herpesvirus 4
cauuuguauugugaggaaaggc

SEQ ID NO: 4577 - RNA, 22 nt, Human herpesvirus 4
ucucccaacacaauagaauuuu

SEQ ID NO: 4578 - RNA, 22 nt, Human herpesvirus 4
gcugcaugugcucuuccccccg

SEQ ID NO: 4579 - RNA, 20 nt, Human herpesvirus 4
gaacggugaccuucgacagc

SEQ ID NO: 4580 - RNA, 22 nt, Human herpesvirus 4
uaaauucuguugcagcagauag

SEQ ID NO: 4581 - RNA, 22 nt, Human herpesvirus 4
uaucuuuugcggcagaaauuga

SEQ ID NO: 4582 - RNA, 22 nt, Human herpesvirus 4
acauugcggaggccauccucga

SEQ ID NO: 4583 - RNA, 22 nt, Human herpesvirus 4
ugacgagggcuuccgccuguuu

SEQ ID NO: 4584 - RNA, 22 nt, Human herpesvirus 4
ccgcccaugggcgcgaguuuag

SEQ ID NO: 4585 - RNA, 22 nt, Human herpesvirus 4
gcaugcugcccagcugaagcgg

SEQ ID NO: 4586 - RNA, 22 nt, Human herpesvirus 4
gcccccggccgcgccagccaag

SEQ ID NO: 4587 - RNA, 20 nt, Human herpesvirus 4
cggggagcgggcaauggagc

SEQ ID NO: 4588 - RNA, 22 nt, Human herpesvirus 4
ucagcgccgccgccgccgacuc

SEQ ID NO: 4589 - RNA, 22 nt, Human herpesvirus 4
aguccaacgccggggagcugcu

SEQ ID NO: 4590 - RNA, 22 nt, Human herpesvirus 4
gagaccuauguauaaagucaau

SEQ ID NO: 4591 - RNA, 22 nt, Human herpesvirus 4
uaaucagaaauuugcacuuucu

SEQ ID NO: 4592 - RNA, 22 nt, Human herpesvirus 4
cgagcggagaguuguauugggg

SEQ ID NO: 4593 - RNA, 18 nt, Human herpesvirus 4
cccccgacucucaccuug

SEQ ID NO: 4594 - RNA, 22 nt, Human herpesvirus 4
ucugcggggacgcauccgccaa

SEQ ID NO: 4595 - RNA, 22 nt, Human herpesvirus 4
uggcuuuaugauuagucccacg

SEQ ID NO: 4596 - RNA, 22 nt, Human herpesvirus 4
cgagcuucucccgcugggccca

SEQ ID NO: 4597 - RNA, 20 nt, Human herpesvirus 4
cucgauccccgggagauucg

SEQ ID NO: 4598 - RNA, 22 nt, Human herpesvirus 4
ugcugacuguauaugcaugagg

SEQ ID NO: 4599 - RNA, 22 nt, Human herpesvirus 4
cggauacagauuaggauagcau

SEQ ID NO: 4600 - RNA, 22 nt, Human herpesvirus 4
ggcucucgaagcuggugaccag

SEQ ID NO: 4601 - RNA, 15 nt, Human herpesvirus 4
acaagcuucucggcc

SEQ ID NO: 4602 - RNA, 22 nt, Human herpesvirus 4
gccacucucauccucaucaaua

SEQ ID NO: 4603 - RNA, 20 nt, Human herpesvirus 4
cuggcugagaugauauuggu

SEQ ID NO: 4604 - RNA, 22 nt, Human herpesvirus 4
uuuauucaaguuuuggccacgu

SEQ ID NO: 4605 - RNA, 22 nt, Human herpesvirus 4
acaccauagucuggaugaaguu

SEQ ID NO: 4606 - RNA, 22 nt, Human herpesvirus 4
gcgcgggcgcagccaugcguga

SEQ ID NO: 4607 - RNA, 22 nt, Human herpesvirus 4
ucgcagggggugugucuggugg

SEQ ID NO: 4608 - RNA, 22 nt, Human herpesvirus 4
ucgcggggcaguauuuucgacc

SEQ ID NO: 4609 - RNA, 22 nt, Human herpesvirus 4
caggcgacugcuccgguagagc

SEQ ID NO: 4610 - RNA, 22 nt, Human herpesvirus 4
uuagauagagugggugugugcu

SEQ ID NO: 4611 - RNA, 22 nt, Human herpesvirus 4
gaucaccacccucuauccauau

SEQ ID NO: 4612 - RNA, 22 nt, Human herpesvirus 4
acauuuguauugugaggaaagg

SEQ ID NO: 4613 - RNA, 22 nt, Human herpesvirus 4
ucucccaacacaauagaauuuu

SEQ ID NO: 4614 - RNA, 22 nt, Human herpesvirus 4
ucacccucggggaccccuggac

SEQ ID NO: 4615 - RNA, 22 nt, Human herpesvirus 4
uugggggcgcccgggggucggg

SEQ ID NO: 4616 - RNA, 22 nt, Human herpesvirus 4
cccggcguuggacuccacgucg

SEQ ID NO: 4617 - RNA, 20 nt, Human herpesvirus 4
aguaggagucggcggcggcg

SEQ ID NO: 4618 - RNA, 22 nt, Human herpesvirus 4
ugauucaggcaggagucuucug

SEQ ID NO: 4619 - RNA, 22 nt, Human herpesvirus 4
gaggcuuuaauguuggacucag

SEQ ID NO: 4620 - RNA, 22 nt, Human herpesvirus 4
ccugggcuuuguggcaccaacc

SEQ ID NO: 4621 - RNA, 16 nt, Human herpesvirus 4
gagccacuagcacagg

SEQ ID NO: 4622 - RNA, 22 nt, Human herpesvirus 4
ggaccuggaauguggggaugag

SEQ ID NO: 4623 - RNA, 22 nt, Human herpesvirus 4
aucaacuauacccagcucauuu

SEQ ID NO: 4624 - RNA, 22 nt, Human herpesvirus 4
ucucgauggccagccggggcca

SEQ ID NO: 4625 - RNA, 19 nt, Human herpesvirus 4
cagguuggccagaaagaga

SEQ ID NO: 4626 - RNA, 22 nt, Human herpesvirus 4
acgaggaggaagagacuucaca

SEQ ID NO: 4627 - RNA, 22 nt, Human herpesvirus 4
uggggucucaggccucccaguc

SEQ ID NO: 4628 - RNA, 22 nt, Human herpesvirus 4
agcagaugugcccaagccugga

SEQ ID NO: 4629 - RNA, 20 nt, Human herpesvirus 4
ucccccggacaccagauguu

SEQ ID NO: 4630 - RNA, 22 nt, Human herpesvirus 4
uggacacuggacccaggcggcg

SEQ ID NO: 4631 - RNA, 21 nt, Human herpesvirus 4
cgccgcacgguccggcacagg

SEQ ID NO: 4632 - RNA, 22 nt, Human herpesvirus 4
ucgagaccaccagagaaaacga

SEQ ID NO: 4633 - RNA, 21 nt, Human herpesvirus 4
caccauccuggacgacaucga

SEQ ID NO: 4634 - RNA, 22 nt, Human herpesvirus 4
ggcaguacggguacagauuucc

SEQ ID NO: 4635 - RNA, 22 nt, Human herpesvirus 4
gaaguagaaagcguguguuugu

SEQ ID NO: 4636 - RNA, 22 nt, Human herpesvirus 4
uccggcucguggaguccgcacc

SEQ ID NO: 4637 - RNA, 18 nt, Human herpesvirus 4
cggaaccaggagaagggg

SEQ ID NO: 4638 - RNA, 22 nt, Human herpesvirus 4
aaguggagggggaucgcccggg

SEQ ID NO: 4639 - RNA, 22 nt, Human herpesvirus 4
cgggcgauccucugagacccuc

SEQ ID NO: 4640 - RNA, 22 nt, Human herpesvirus 4
aaguggagggggaucgcccggg

SEQ ID NO: 4641 - RNA, 22 nt, Human herpesvirus 4
cgggcgauccucugagacccuc

SEQ ID NO: 4642 - RNA, 22 nt, Human herpesvirus 4
aaguggagggggaucgcccggg

SEQ ID NO: 4643 - RNA, 22 nt, Human herpesvirus 4
cgggcgauccucugagacccuc

SEQ ID NO: 4644 - RNA, 22 nt, Human herpesvirus 4
aaguggagggggaucgcccggg

SEQ ID NO: 4645 - RNA, 22 nt, Human herpesvirus 4
cgggcgauccucugagacccuc

SEQ ID NO: 4646 - RNA, 22 nt, Human herpesvirus 4
aaguggagggggaucgcccggg

SEQ ID NO: 4647 - RNA, 22 nt, Human herpesvirus 4
cgggcgauccucugagacccuc

SEQ ID NO: 4648 - RNA, 22 nt, Human herpesvirus 4
aaguggagggggaucgcccggg

SEQ ID NO: 4649 - RNA, 22 nt, Human herpesvirus 4
cgggcgauccucugagacccuc

SEQ ID NO: 4650 - RNA, 22 nt, Human herpesvirus 4
ccugguccaagaguaaaagcag

SEQ ID NO: 4651 - RNA, 22 nt, Human herpesvirus 4
ugccauaaguccucauggcagg

SEQ ID NO: 4652 - RNA, 22 nt, Human herpesvirus 4
aagucccgagcggccuccgccg

SEQ ID NO: 4653 - RNA, 22 nt, Human herpesvirus 4
aggcaauggucgccaggguuuc

SEQ ID NO: 4654 - RNA, 22 nt, Human herpesvirus 4
ccgcguaccagccauuguagau

SEQ ID NO: 4655 - RNA, 20 nt, Human herpesvirus 4
cuaucuugguguaggagcgg

SEQ ID NO: 4656 - RNA, 22 nt, Human herpesvirus 4
agcuuauuuuuugguugugcgg

SEQ ID NO: 4657 - RNA, 21 nt, Human herpesvirus 4
gcguuuuccgauagaauagcu

SEQ ID NO: 4658 - RNA, 22 nt, Human herpesvirus 4
ucagacaguuuggugcgcuagu

SEQ ID NO: 4659 - RNA, 22 nt, Human herpesvirus 4
cgcacaccaggcugacugccuu

SEQ ID NO: 4660 - RNA, 22 nt, Human herpesvirus 4
agguuaugacauuuuauuuaca

SEQ ID NO: 4661 - RNA, 20 nt, Human herpesvirus 4
uaguuguuauugcccuuaau

SEQ ID NO: 4662 - RNA, 22 nt, Human herpesvirus 4
uccaacagccuggaaucgggau

SEQ ID NO: 4663 - RNA, 22 nt, Human herpesvirus 4
cuggacaccgccaggagccaau

SEQ ID NO: 4664 - RNA, 22 nt, Human herpesvirus 4
gggccaccucuuugguucugua

SEQ ID NO: 4665 - RNA, 22 nt, Human herpesvirus 4
uacauaaccauggaguuggcug

SEQ ID NO: 4666 - RNA, 22 nt, Human herpesvirus 4
ccugugcuaguggcuccucuga

SEQ ID NO: 4667 - RNA, 22 nt, Human herpesvirus 4
gagguuggugccacaaagccca

SEQ ID NO: 4668 - RNA, 22 nt, Human herpesvirus 4
agugucagauuucggguccaaa

SEQ ID NO: 4669 - RNA, 21 nt, Human herpesvirus 4
uuaccuguuacugcacccgcu

SEQ ID NO: 4670 - RNA, 22 nt, Human herpesvirus 4
gcucuagcaggguaaagagccg

SEQ ID NO: 4671 - RNA, 15 nt, Human herpesvirus 4
uuugccucucgaugc

SEQ ID NO: 4672 - RNA, 22 nt, Human herpesvirus 4
cggauggcaucggccgccgucc

SEQ ID NO: 4673 - RNA, 20 nt, Human herpesvirus 4
ggccccggccgcuuccuccg

SEQ ID NO: 4674 - RNA, 22 nt, Human herpesvirus 4
ucuuaguggaagugacgugcug

SEQ ID NO: 4675 - RNA, 22 nt, Human herpesvirus 4
gcaccgcuauccacuaugucuc

SEQ ID NO: 4676 - RNA, 22 nt, Human herpesvirus 4
gguacccuacgcugccgauuua

SEQ ID NO: 4677 - RNA, 22 nt, Human herpesvirus 4
aaugcugcaguaguagggaucu

SEQ ID NO: 4678 - RNA, 22 nt, Human herpesvirus 4
gccguacuuugguuguggacca

SEQ ID NO: 4679 - RNA, 15 nt, Human herpesvirus 4
cggccagagggcggc

SEQ ID NO: 4680 - RNA, 22 nt, Human herpesvirus 4
uaacgaagagcgugaagcaccg

SEQ ID NO: 4681 - RNA, 22 nt, Human herpesvirus 4
gugugcuuacacacuucccguu

SEQ ID NO: 4682 - RNA, 22 nt, Human herpesvirus 4
gagcucggggggcggccgggug

SEQ ID NO: 4683 - RNA, 20 nt, Human herpesvirus 4
cuggguccgcugccccgcuc

SEQ ID NO: 4684 - RNA, 22 nt, Human herpesvirus 4
gagcucggggggcggccgggug

SEQ ID NO: 4685 - RNA, 20 nt, Human herpesvirus 4
cuggguccgcugccccgcuc

SEQ ID NO: 4686 - RNA, 22 nt, Human herpesvirus 4
gagcucggggggcggccgggug

SEQ ID NO: 4687 - RNA, 20 nt, Human herpesvirus 4
cuggguccgcugccccgcuc

SEQ ID NO: 4688 - RNA, 22 nt, Human herpesvirus 4
gagcucggggggcggccgggug

SEQ ID NO: 4689 - RNA, 20 nt, Human herpesvirus 4
cuggguccgcugccccgcuc

SEQ ID NO: 4690 - RNA, 22 nt, Human herpesvirus 4
uucuccccucgcugccucacug

SEQ ID NO: 4691 - RNA, 20 nt, Human herpesvirus 4
uggaacaggcgggguugagg

SEQ ID NO: 4692 - RNA, 22 nt, Human herpesvirus 4
uacuccgagucuuucgagccag

SEQ ID NO: 4693 - RNA, 20 nt, Human herpesvirus 4
uugcacgccaggccgugugg

SEQ ID NO: 4694 - RNA, 22 nt, Human herpesvirus 4
gccaucaacagguggggguugu

SEQ ID NO: 4695 - RNA, 20 nt, Human herpesvirus 4
aucccccgagcagcuuuggc

SEQ ID NO: 4696 - RNA, 22 nt, Human herpesvirus 4
ggugucugcagcaaaagaggaa

SEQ ID NO: 4697 - RNA, 22 nt, Human herpesvirus 4
agucaguuauuuugcaugccac

SEQ ID NO: 4698 - RNA, 22 nt, Human herpesvirus 4
uuggucucggccccggcccuaa

SEQ ID NO: 4699 - RNA, 20 nt, Human herpesvirus 4
gcaaagggccggacucccag

SEQ ID NO: 4700 - RNA, 22 nt, Human herpesvirus 4
ccgcccuccuccucuuacccug

SEQ ID NO: 4701 - RNA, 22 nt, Human herpesvirus 4
aggaguagaacaauaacaagug

SEQ ID NO: 4702 - RNA, 22 nt, Human herpesvirus 4
ggauuggaagaaaugacgcugg

SEQ ID NO: 4703 - RNA, 16 nt, Human herpesvirus 4
agcguguuucuuaucc

SEQ ID NO: 4704 - RNA, 22 nt, Human herpesvirus 4
gcuuuuagccacggaggacauu

SEQ ID NO: 4705 - RNA, 19 nt, Human herpesvirus 4
ggggaauacguggcggagc

SEQ ID NO: 4706 - RNA, 22 nt, Human herpesvirus 4
ucucuuucuggccaaccugccu

SEQ ID NO: 4707 - RNA, 19 nt, Human herpesvirus 4
ccccggcuggccaucgaga

SEQ ID NO: 4708 - RNA, 22 nt, Human herpesvirus 4
ugaggcugcugcuuuccucgga

SEQ ID NO: 4709 - RNA, 16 nt, Human herpesvirus 4
gaugcguguagcccag

SEQ ID NO: 4710 - RNA, 22 nt, Human herpesvirus 4
ucauccccugcuugggacccga

SEQ ID NO: 4711 - RNA, 22 nt, Human herpesvirus 4
cggugguccugcggggggugac

SEQ ID NO: 4712 - RNA, 22 nt, Human herpesvirus 4
cggagguguuggagucauuuac

SEQ ID NO: 4713 - RNA, 22 nt, Human herpesvirus 4
uaaggcuauaauuguaaccccc

SEQ ID NO: 4714 - RNA, 22 nt, Human herpesvirus 4
ggcagguggagugggacacagu

SEQ ID NO: 4715 - RNA, 18 nt, Human herpesvirus 4
ucccuaucuccacccgcc

SEQ ID NO: 4716 - RNA, 22 nt, Human herpesvirus 4
aacagguggucgugggauggcg

SEQ ID NO: 4717 - RNA, 20 nt, Human herpesvirus 4
cucgggucucgccgcuaguu

SEQ ID NO: 4718 - RNA, 22 nt, Human herpesvirus 4
uggcacagcuguugccagggug

SEQ ID NO: 4719 - RNA, 22 nt, Human herpesvirus 4
cagaugcaggagcugacccagg

SEQ ID NO: 4720 - RNA, 22 nt, Human herpesvirus 4
cacccgcccaucaccaccggac

SEQ ID NO: 4721 - RNA, 22 nt, Human herpesvirus 4
uccugugguguuuggugugguu

SEQ ID NO: 4722 - RNA, 22 nt, Human herpesvirus 4
ggcauaugcucuauacccgccc

SEQ ID NO: 4723 - RNA, 22 nt, Human herpesvirus 4
gcccaggaucuauagguauggg

SEQ ID NO: 4724 - RNA, 22 nt, Human herpesvirus 4
ucccaguucuuguuacaugggc

SEQ ID NO: 4725 - RNA, 22 nt, Human herpesvirus 4
ucgauguuucagaagaggaagg

SEQ ID NO: 4726 - RNA, 22 nt, Human herpesvirus 4
cguaccgggccagcagagcaag

SEQ ID NO: 4727 - RNA, 22 nt, Human herpesvirus 4
cauucgaacccuaccggcggau

SEQ ID NO: 4728 - RNA, 22 nt, Human herpesvirus 4
cggucucuggaucgugauagcg

SEQ ID NO: 4729 - RNA, 22 nt, Human herpesvirus 4
uggaaaacggucccuggcugcc

SEQ ID NO: 4730 - RNA, 22 nt, Human herpesvirus 4
uguacaucuuuugcaggcuuuc

SEQ ID NO: 4731 - RNA, 21 nt, Human herpesvirus 4
ugguugcccagcuugaugacg

SEQ ID NO: 4732 - RNA, 22 nt, Human herpesvirus 4
ugagcagggcuucguccagggg

SEQ ID NO: 4733 - RNA, 22 nt, Human herpesvirus 4
uuggcggacaucauuagcccag

SEQ ID NO: 4734 - RNA, 22 nt, Human herpesvirus 4
gggagucuugguagaagcacag

SEQ ID NO: 4735 - RNA, 20 nt, Human herpesvirus 4
ccccgcacauccaccacccc

SEQ ID NO: 4736 - RNA, 22 nt, Human herpesvirus 4
cccagcuccagcagcucuuccc

SEQ ID NO: 4737 - RNA, 22 nt, Human herpesvirus 4
gagggggcgcugcuggugugag

SEQ ID NO: 4738 - RNA, 22 nt, Human herpesvirus 4
agaagcugggagaugguggcua

SEQ ID NO: 4739 - RNA, 20 nt, Human herpesvirus 4
uaguuauaguaaaugcaucu

SEQ ID NO: 4740 - RNA, 22 nt, Human herpesvirus 4
ucuaaaguuccucaacaggcca

SEQ ID NO: 4741 - RNA, 19 nt, Human herpesvirus 4
gccuugggggagcuggggg

SEQ ID NO: 4742 - RNA, 22 nt, Human herpesvirus 4
aagagcuccaaagccaggcucg

SEQ ID NO: 4743 - RNA, 22 nt, Human herpesvirus 4
ggccacacggccggagcuccgg

SEQ ID NO: 4744 - RNA, 22 nt, Human herpesvirus 4
ggaaauuggugccccucucugc

SEQ ID NO: 4745 - RNA, 21 nt, Human herpesvirus 4
gccauggugucauccaucucc

SEQ ID NO: 4746 - RNA, 22 nt, Human herpesvirus 4
ggcacccgggcccgcgucgagc

SEQ ID NO: 4747 - RNA, 21 nt, Human herpesvirus 4
ugucugcgggccacgguggcc

SEQ ID NO: 4748 - RNA, 22 nt, Human herpesvirus 4
ggucagacggccgcgcugcgag

SEQ ID NO: 4749 - RNA, 22 nt, Human herpesvirus 4
cgcggucaaggccgauaugccc

SEQ ID NO: 4750 - RNA, 22 nt, Human herpesvirus 4
aggacagggguguggccaauau

SEQ ID NO: 4751 - RNA, 19 nt, Human herpesvirus 4
ccagcgacgccccggaccu

SEQ ID NO: 4752 - RNA, 22 nt, Human herpesvirus 4
accacaccaaacaccacaggac

SEQ ID NO: 4753 - RNA, 20 nt, Human herpesvirus 4
uccgguggugaugggcgggu

SEQ ID NO: 4754 - RNA, 22 nt, Human herpesvirus 4
ugacguuaauuggaagcuucuu

SEQ ID NO: 4755 - RNA, 20 nt, Human herpesvirus 4
uagagccaauucuccugcac

SEQ ID NO: 4756 - RNA, 22 nt, Human herpesvirus 4
gguacugggggugcgccgugaa

SEQ ID NO: 4757 - RNA, 15 nt, Human herpesvirus 4
uucagcgccuccacc

SEQ ID NO: 4758 - RNA, 22 nt, Human herpesvirus 4
ccuaggcuuggauggcggaguc

SEQ ID NO: 4759 - RNA, 20 nt, Human herpesvirus 4
aagguggccccgggcgcagg

SEQ ID NO: 4760 - RNA, 22 nt, Human herpesvirus 4
ccuaggcuuggauggcggaguc

SEQ ID NO: 4761 - RNA, 20 nt, Human herpesvirus 4
aagguggccccgggcgcagg

SEQ ID NO: 4762 - RNA, 22 nt, Human herpesvirus 4
uugagcugccuaccaugcuaua

SEQ ID NO: 4763 - RNA, 20 nt, Human herpesvirus 4
ugcugagagcaaggcaccaa

SEQ ID NO: 4764 - RNA, 22 nt, Human herpesvirus 4
ccgaugagacaacggccgagau

SEQ ID NO: 4765 - RNA, 21 nt, Human herpesvirus 4
ucucguccaucuugagcgccg

SEQ ID NO: 4766 - RNA, 22 nt, Human herpesvirus 4
uaauccgucagcagcguguuca

SEQ ID NO: 4767 - RNA, 22 nt, Human herpesvirus 4
cuuguuaaagcagacguacauc

SEQ ID NO: 4768 - RNA, 22 nt, Human herpesvirus 4
ugcauccgccgguaggguucga

SEQ ID NO: 4769 - RNA, 21 nt, Human herpesvirus 4
gcuugcucugcuggcccggua

SEQ ID NO: 4770 - RNA, 22 nt, Human herpesvirus 4
ucauguuggucauggguaggcu

SEQ ID NO: 4771 - RNA, 16 nt, Human herpesvirus 4
ccgaggcacggaagag

SEQ ID NO: 4772 - RNA, 22 nt, Human herpesvirus 4
uccauggcacauuuagagauaa

SEQ ID NO: 4773 - RNA, 22 nt, Human herpesvirus 4
ugucuugcucaugugcagagga

SEQ ID NO: 4774 - RNA, 22 nt, Human herpesvirus 4
augagguuagcguggacaguuu

SEQ ID NO: 4775 - RNA, 22 nt, Human herpesvirus 4
uuguuccaggucagaccuacgc

SEQ ID NO: 4776 - RNA, 22 nt, Human herpesvirus 4
gagauugccaagaugcaacaga

SEQ ID NO: 4777 - RNA, 22 nt, Human herpesvirus 4
uggcugcaucuuaccccuggcu

SEQ ID NO: 4778 - RNA, 22 nt, Human herpesvirus 4
gcgcgccccccgggccccagug

SEQ ID NO: 4779 - RNA, 22 nt, Human herpesvirus 4
aucuggggucccuaguuccaaa

SEQ ID NO: 4780 - RNA, 22 nt, Human herpesvirus 4
uagcacagcaccacccugagcc

SEQ ID NO: 4781 - RNA, 22 nt, Human herpesvirus 4
ucguaguggucguuguacacug

SEQ ID NO: 4782 - RNA, 22 nt, Human herpesvirus 4
ugccgggagccggaacuggaca

SEQ ID NO: 4783 - RNA, 18 nt, Human herpesvirus 4
auguuugagguuucugug

SEQ ID NO: 4784 - RNA, 22 nt, Human herpesvirus 4
ugacggggccccuccgaugccu

SEQ ID NO: 4785 - RNA, 22 nt, Human herpesvirus 4
gcggucggacugcgcccccuca

SEQ ID NO: 4786 - RNA, 22 nt, Human herpesvirus 4
ucgagcacgcgccggcagcgug

SEQ ID NO: 4787 - RNA, 22 nt, Human herpesvirus 4
ccgucuuccggacgagcuccac

SEQ ID NO: 4788 - RNA, 22 nt, Human herpesvirus 4
cgacccgugacugguagcuguc

SEQ ID NO: 4789 - RNA, 20 nt, Human herpesvirus 4
gaccucuggucuugguuucg

SEQ ID NO: 4790 - RNA, 22 nt, Human herpesvirus 4
gauuaggauagccuaugcuacc

SEQ ID NO: 4791 - RNA, 22 nt, Human herpesvirus 4
uagcauaugcuacccagauaua

SEQ ID NO: 4792 - RNA, 22 nt, Human herpesvirus 4
agccaccauuuuaccagggacg

SEQ ID NO: 4793 - RNA, 22 nt, Human herpesvirus 4
gacaauuuggagaaugggacgc

SEQ ID NO: 4794 - RNA, 22 nt, Human herpesvirus 4
uguagaccagccgcccuguuga

SEQ ID NO: 4795 - RNA, 22 nt, Human herpesvirus 4
aggccuucgcuggcuucuaaca

SEQ ID NO: 4796 - RNA, 22 nt, Human herpesvirus 4
cauggcugcgcccgcgcggcgc

SEQ ID NO: 4797 - RNA, 22 nt, Human herpesvirus 4
ccgccauccaccgcccgcagcc

SEQ ID NO: 4798 - RNA, 22 nt, Human herpesvirus 4
ucacauaaaguccccccuggac

SEQ ID NO: 4799 - RNA, 15 nt, Human herpesvirus 4
ggggggcggggaugg

SEQ ID NO: 4800 - RNA, 22 nt, Human herpesvirus 4
ucacauaaaguccccccuggac

SEQ ID NO: 4801 - RNA, 15 nt, Human herpesvirus 4
ggggggcggggaugg

SEQ ID NO: 4802 - RNA, 22 nt, Human herpesvirus 4
gagcuccggccguguggccgag

SEQ ID NO: 4803 - RNA, 22 nt, Human herpesvirus 4
ucgagccuggcuuuggagcucu

SEQ ID NO: 4804 - RNA, 22 nt, Human herpesvirus 4
cggccucccgccugccgccaac

SEQ ID NO: 4805 - RNA, 21 nt, Human herpesvirus 4
ugcgcgccccgcgccucuuug

SEQ ID NO: 4806 - RNA, 22 nt, Human herpesvirus 4
ucgcguauaugagugugguccu

SEQ ID NO: 4807 - RNA, 22 nt, Human herpesvirus 4
auccuacaaacucaauaaauga

SEQ ID NO: 4808 - RNA, 22 nt, Human herpesvirus 4
gggcggugacauuuucaaauuu

SEQ ID NO: 4809 - RNA, 22 nt, Human herpesvirus 4
aucugagaaaaaugcacaaaca

SEQ ID NO: 4810 - RNA, 22 nt, Human herpesvirus 4
gcacgauguuggagcgggccaa

SEQ ID NO: 4811 - RNA, 20 nt, Human herpesvirus 4
ccugagccccgccaaccugc

SEQ ID NO: 4812 - RNA, 22 nt, Human herpesvirus 4
ucacuucugaggacgcaaacuc

SEQ ID NO: 4813 - RNA, 20 nt, Human herpesvirus 4
ugacugccuuuugggccugg

SEQ ID NO: 4814 - RNA, 22 nt, Human herpesvirus 4
gagcuccuaggucagaccacga

SEQ ID NO: 4815 - RNA, 16 nt, Human herpesvirus 4
uggauggcguguuuuc

SEQ ID NO: 4816 - RNA, 22 nt, Human herpesvirus 4
uccuugcggcggccuccccccc

SEQ ID NO: 4817 - RNA, 20 nt, Human herpesvirus 4
gcgcggggucccugccuggc

SEQ ID NO: 4818 - RNA, 22 nt, Human herpesvirus 4
acccagcccuccucggcccugu

SEQ ID NO: 4819 - RNA, 22 nt, Human herpesvirus 4
gcacggacccggaggcugcguc

SEQ ID NO: 4820 - RNA, 22 nt, Human herpesvirus 4
ccugcacgagaccccugggcuc

SEQ ID NO: 4821 - RNA, 20 nt, Human herpesvirus 4
ccaggucuugccaauugggg

SEQ ID NO: 4822 - RNA, 22 nt, Human herpesvirus 4
ucuggagugccuuucgcgugaa

SEQ ID NO: 4823 - RNA, 22 nt, Human herpesvirus 4
ugcccugagacguacucgaguu

SEQ ID NO: 4824 - RNA, 22 nt, Human herpesvirus 4
gcuccuaaaguuggugcacagc

SEQ ID NO: 4825 - RNA, 22 nt, Human herpesvirus 4
cuuuagccacucuggggggcuc

SEQ ID NO: 4826 - RNA, 22 nt, Human herpesvirus 4
ggcgccaggcgcggggccgguc

SEQ ID NO: 4827 - RNA, 22 nt, Human herpesvirus 4
ccgagacccgggucuggggggc

SEQ ID NO: 4828 - RNA, 22 nt, Human herpesvirus 4
ggcgccaggcgcggggccgguc

SEQ ID NO: 4829 - RNA, 22 nt, Human herpesvirus 4
ccgagacccgggucuggggggc

SEQ ID NO: 4830 - RNA, 22 nt, Human herpesvirus 4
uuguucagaagcccagggacuu

SEQ ID NO: 4831 - RNA, 20 nt, Human herpesvirus 4
uguggugcugguuggggaag

SEQ ID NO: 4832 - RNA, 22 nt, Human herpesvirus 4
aaucugcagguagagguagggg

SEQ ID NO: 4833 - RNA, 22 nt, Human herpesvirus 4
ccuuucucuaugaacaggcugc

SEQ ID NO: 4834 - RNA, 22 nt, Human herpesvirus 4
uaacgggaaguguguaagcaca

SEQ ID NO: 4835 - RNA, 22 nt, Human herpesvirus 4
ugcuucacgcucuucguuaaaa

SEQ ID NO: 4836 - RNA, 22 nt, Human herpesvirus 4
cgggggcugcugcugaguugga

SEQ ID NO: 4837 - RNA, 19 nt, Human herpesvirus 4
gugguggugggggcugcug

SEQ ID NO: 4838 - RNA, 22 nt, Human herpesvirus 4
ucccuggacacuggacuaugau

SEQ ID NO: 4839 - RNA, 22 nt, Human herpesvirus 4
uuucauagucaagguccaggau

SEQ ID NO: 4840 - RNA, 22 nt, Human herpesvirus 4
ucggucuccccuaggcuuggau

SEQ ID NO: 4841 - RNA, 21 nt, Human herpesvirus 4
cccgggcgcagggcaagacga

SEQ ID NO: 4842 - RNA, 22 nt, Human herpesvirus 4
gcugggccaggaugacuucauu

SEQ ID NO: 4843 - RNA, 20 nt, Human herpesvirus 4
ccuggucuucccugcugagc

SEQ ID NO: 4844 - RNA, 22 nt, Human herpesvirus 4
acuguggucaaucaccucuauc

SEQ ID NO: 4845 - RNA, 22 nt, Human herpesvirus 4
aaugagaaugucaucuccgggg

SEQ ID NO: 4846 - RNA, 22 nt, Human herpesvirus 4
uugggaaaguuguugggugaaa

SEQ ID NO: 4847 - RNA, 15 nt, Human herpesvirus 4
ccaaagacgccggau

SEQ ID NO: 4848 - RNA, 22 nt, Human herpesvirus 4
uuugggguugggguagucacug

SEQ ID NO: 4849 - RNA, 22 nt, Human herpesvirus 4
cugguggcauuugggguugggg

SEQ ID NO: 4850 - RNA, 22 nt, Human herpesvirus 4
aaguggagggggaucgcccggg

SEQ ID NO: 4851 - RNA, 22 nt, Human herpesvirus 4
cgggcgauccucugagacccuc

SEQ ID NO: 4852 - RNA, 22 nt, Human herpesvirus 4
uugggcuagcucuuaguuucug

SEQ ID NO: 4853 - RNA, 18 nt, Human herpesvirus 4
uaaagugcuuaugcgcaa

SEQ ID NO: 4854 - RNA, 22 nt, Human herpesvirus 4
uaagaaacaguagagggcacga

SEQ ID NO: 4855 - RNA, 17 nt, Human herpesvirus 4
uuauuaauaaacaauua

SEQ ID NO: 4856 - RNA, 22 nt, Human herpesvirus 4
ggcgcaagggcuggauaccccu

SEQ ID NO: 4857 - RNA, 21 nt, Human herpesvirus 4
guacuaacacgcaauaaaguu

SEQ ID NO: 4858 - RNA, 22 nt, Human herpesvirus 4
uccaaagaacaaaaacgcgacc

SEQ ID NO: 4859 - RNA, 22 nt, Human herpesvirus 4
uagguggucguguugaaggaga

SEQ ID NO: 4860 - RNA, 22 nt, Human herpesvirus 4
ggugugguggaguguugggcuu

SEQ ID NO: 4861 - RNA, 18 nt, Human herpesvirus 4
guccacuuaccucuggcc

SEQ ID NO: 4862 - RNA, 22 nt, Human herpesvirus 4
ugguguuggggcggguguuccu

SEQ ID NO: 4863 - RNA, 17 nt, Human herpesvirus 4
cccugccuccggcccca

SEQ ID NO: 4864 - RNA, 22 nt, Human herpesvirus 4
agcucguccggaagacggccug

SEQ ID NO: 4865 - RNA, 21 nt, Human herpesvirus 4
gacacgcugccggcgcgugcu

SEQ ID NO: 4866 - RNA, 22 nt, Human herpesvirus 4
uuugaggccaucuucaccuccc

SEQ ID NO: 4867 - RNA, 22 nt, Human herpesvirus 4
ggcugaaaccaaggccuuugag

SEQ ID NO: 4868 - RNA, 22 nt, Human herpesvirus 4
gccugcccuccgccaucaggcg

SEQ ID NO: 4869 - RNA, 20 nt, Human herpesvirus 4
gccccuggcagagagguggc

SEQ ID NO: 4870 - RNA, 22 nt, Human herpesvirus 4
uaaccugaucagccccggaguu

SEQ ID NO: 4871 - RNA, 22 nt, Human herpesvirus 4
ccccgggccugaagagguugac

SEQ ID NO: 4872 - RNA, 22 nt, Human herpesvirus 4
ggguucggacguggagcuagag

SEQ ID NO: 4873 - RNA, 18 nt, Human herpesvirus 4
cugccauauaucgauccc

SEQ ID NO: 4874 - RNA, 22 nt, Human herpesvirus 4
ucaagauguucaaggacgugga

SEQ ID NO: 4875 - RNA, 22 nt, Human herpesvirus 4
uccaguuuaugaacagcauggc

SEQ ID NO: 4876 - RNA, 22 nt, Human herpesvirus 4
gcguguacgcggaggccagcgg

SEQ ID NO: 4877 - RNA, 20 nt, Human herpesvirus 4
cccgucgcggcugugcccgu

SEQ ID NO: 4878 - RNA, 22 nt, Human herpesvirus 4
ugguaccuggagguuauucuau

SEQ ID NO: 4879 - RNA, 17 nt, Human herpesvirus 4
gaggggcuagagguccg

SEQ ID NO: 4880 - RNA, 22 nt, Human herpesvirus 4
cagucagccuggugugcguugc

SEQ ID NO: 4881 - RNA, 22 nt, Human herpesvirus 4
aacuagcgcaccaaacugucug

SEQ ID NO: 4882 - RNA, 22 nt, Human herpesvirus 4
gccugcaagacucuugccagga

SEQ ID NO: 4883 - RNA, 19 nt, Human herpesvirus 4
gcugucaggaguggguggc

SEQ ID NO: 4884 - RNA, 22 nt, Human herpesvirus 4
ugcuggacaugacggugguugg

SEQ ID NO: 4885 - RNA, 22 nt, Human herpesvirus 4
ucucucagcaccauguucugcc

SEQ ID NO: 4886 - RNA, 22 nt, Human herpesvirus 4
gcauaauggcggaccuaggccu

SEQ ID NO: 4887 - RNA, 16 nt, Human herpesvirus 4
gucuaugguuggcugc

SEQ ID NO: 4888 - RNA, 22 nt, Human herpesvirus 4
gcauaauggcggaccuaggccu

SEQ ID NO: 4889 - RNA, 16 nt, Human herpesvirus 4
gucuaugguuggcugc

SEQ ID NO: 4890 - RNA, 22 nt, Human herpesvirus 4
gcauaauggcggaccuaggccu

SEQ ID NO: 4891 - RNA, 16 nt, Human herpesvirus 4
gucuaugguuggcugc

SEQ ID NO: 4892 - RNA, 22 nt, Human herpesvirus 4
ugaaagagguagcgccccaggu

SEQ ID NO: 4893 - RNA, 22 nt, Human herpesvirus 4
ugggucacgucccacucggagc

SEQ ID NO: 4894 - RNA, 22 nt, Human herpesvirus 4
ggacauggccaggaucaggucu

SEQ ID NO: 4895 - RNA, 22 nt, Human herpesvirus 4
agacaggcccaccacgucuuca

SEQ ID NO: 4896 - RNA, 22 nt, Human herpesvirus 4
uuucaacacagcaggccucucc

SEQ ID NO: 4897 - RNA, 20 nt, Human herpesvirus 4
gagcguggccgcaaaucagg

SEQ ID NO: 4898 - RNA, 22 nt, Human herpesvirus 4
cccucccucucccucguccugg

SEQ ID NO: 4899 - RNA, 20 nt, Human herpesvirus 4
aggaggagaaggagaauggg

SEQ ID NO: 4900 - RNA, 22 nt, Human herpesvirus 4
uccucugcacaugagcaagaca

SEQ ID NO: 4901 - RNA, 22 nt, Human herpesvirus 4
uuuaucucuaaaugugccaugg

SEQ ID NO: 4902 - RNA, 22 nt, Human herpesvirus 4
uuaucuggcacgggugcuggcu

SEQ ID NO: 4903 - RNA, 20 nt, Human herpesvirus 4
ccugcuccugauguuucuga

SEQ ID NO: 4904 - RNA, 22 nt, Human herpesvirus 4
ugcuggccuugagggcgcugag

SEQ ID NO: 4905 - RNA, 18 nt, Human herpesvirus 4
uccagacccugaggcgcg

SEQ ID NO: 4906 - RNA, 22 nt, Human herpesvirus 4
uggaacucgugacagaugucua

SEQ ID NO: 4907 - RNA, 22 nt, Human herpesvirus 4
uggagaucaucgacgagcucua

SEQ ID NO: 4908 - RNA, 22 nt, Human herpesvirus 4
gaaucuucuccggcagggugac

SEQ ID NO: 4909 - RNA, 22 nt, Human herpesvirus 4
caccuugucacggagccaggaa

SEQ ID NO: 4910 - RNA, 22 nt, Human herpesvirus 4
accuuccucugcccgcuucuuc

SEQ ID NO: 4911 - RNA, 21 nt, Human herpesvirus 4
gagaguagggagggggaggga

SEQ ID NO: 4912 - RNA, 22 nt, Human herpesvirus 4
gcagccucccuucaucuccagc

SEQ ID NO: 4913 - RNA, 22 nt, Human herpesvirus 4
uggagaacguagcgagcguagc

SEQ ID NO: 4914 - RNA, 22 nt, Human herpesvirus 4
gaaggggggcgauggggcggaa

SEQ ID NO: 4915 - RNA, 22 nt, Human herpesvirus 4
gcagcugaucauccucuguguc

SEQ ID NO: 4916 - RNA, 22 nt, Human herpesvirus 4
uaagguugguccaauccauagg

SEQ ID NO: 4917 - RNA, 22 nt, Human herpesvirus 4
cggggaucggacuagccuuaga

SEQ ID NO: 4918 - RNA, 22 nt, Human herpesvirus 4
gcaucugcucagcgggacuccg

SEQ ID NO: 4919 - RNA, 18 nt, Human herpesvirus 4
ccgcggcaccgacagagc

SEQ ID NO: 4920 - RNA, 22 nt, Human herpesvirus 4
cgaggccgggcggaaggaggcg

SEQ ID NO: 4921 - RNA, 22 nt, Human herpesvirus 4
ccccgcggcaggaggcccagcg

SEQ ID NO: 4922 - RNA, 22 nt, Human herpesvirus 4
uaugacguugcucucuucgugg

SEQ ID NO: 4923 - RNA, 21 nt, Human herpesvirus 4
acaaagagggccaggucagag

SEQ ID NO: 4924 - RNA, 22 nt, Human herpesvirus 4
acauuccccgcaaacaugacau

SEQ ID NO: 4925 - RNA, 22 nt, Human herpesvirus 4
uguuuuguuugcuugggaaugc

SEQ ID NO: 4926 - RNA, 22 nt, Human herpesvirus 4
ccagauuuguuguaggagcagc

SEQ ID NO: 4927 - RNA, 21 nt, Human herpesvirus 4
ugcccugaccgcgcgucgagg

SEQ ID NO: 4928 - RNA, 22 nt, Human herpesvirus 4
uaacauuguacagagcuguaau

SEQ ID NO: 4929 - RNA, 22 nt, Human herpesvirus 4
caguauuuucuuugacuauaug

SEQ ID NO: 4930 - RNA, 22 nt, Human herpesvirus 4
ugaggagcaccggagccaccac

SEQ ID NO: 4931 - RNA, 22 nt, Human herpesvirus 4
ggagcagggcccagugcaccca

SEQ ID NO: 4932 - RNA, 22 nt, Human herpesvirus 4
gcaccaggcccgcgcaaggucu

SEQ ID NO: 4933 - RNA, 18 nt, Human herpesvirus 4
ucuggcggcgcagggagu

SEQ ID NO: 4934 - RNA, 22 nt, Human herpesvirus 4
ccacugacaggucauccagguc

SEQ ID NO: 4935 - RNA, 18 nt, Human herpesvirus 4
uggaagagauucaagagg

SEQ ID NO: 4936 - RNA, 22 nt, Human herpesvirus 4
agauguccagggguccccgagg

SEQ ID NO: 4937 - RNA, 18 nt, Human herpesvirus 4
cucccgccccuguccacu

SEQ ID NO: 4938 - RNA, 22 nt, Human herpesvirus 4
agauguccagggguccccgagg

SEQ ID NO: 4939 - RNA, 18 nt, Human herpesvirus 4
cucccgccccuguccacu

SEQ ID NO: 4940 - RNA, 22 nt, Human herpesvirus 4
agauguccagggguccccgagg

SEQ ID NO: 4941 - RNA, 18 nt, Human herpesvirus 4
cucccgccccuguccacu

SEQ ID NO: 4942 - RNA, 22 nt, Human herpesvirus 4
ggaagccugcuccacagccgag

SEQ ID NO: 4943 - RNA, 22 nt, Human herpesvirus 4
uccuugcccaggacacaggugc

SEQ ID NO: 4944 - RNA, 22 nt, Human herpesvirus 4
aaaauacaccagcuauaaggaa

SEQ ID NO: 4945 - RNA, 19 nt, Human herpesvirus 4
uuguuccucagguggcuuu

SEQ ID NO: 4946 - RNA, 22 nt, Human herpesvirus 4
ugacagugggagaaacacggcc

SEQ ID NO: 4947 - RNA, 17 nt, Human herpesvirus 4
gguguucaucucacgca

SEQ ID NO: 4948 - RNA, 22 nt, Human herpesvirus 4
gcaccucccuucacaucccaga

SEQ ID NO: 4949 - RNA, 20 nt, Human herpesvirus 4
uguuaugugaaaacauaggc

SEQ ID NO: 4950 - RNA, 22 nt, Human herpesvirus 4
gcaggguugcugaggccggggu

SEQ ID NO: 4951 - RNA, 22 nt, Human herpesvirus 4
ccgagggccuuagaggccaagg

SEQ ID NO: 4952 - RNA, 22 nt, Human herpesvirus 4
gcaggguugcugaggccggggu

SEQ ID NO: 4953 - RNA, 22 nt, Human herpesvirus 4
ccgagggccuuagaggccaagg

SEQ ID NO: 4954 - RNA, 22 nt, Human herpesvirus 4
gcaggguugcugaggccggggu

SEQ ID NO: 4955 - RNA, 22 nt, Human herpesvirus 4
ccgagggccuuagaggccaagg

SEQ ID NO: 4956 - RNA, 22 nt, Human herpesvirus 4
gcaggguugcugaggccggggu

SEQ ID NO: 4957 - RNA, 22 nt, Human herpesvirus 4
ccgagggccuuagaggccaagg

SEQ ID NO: 4958 - RNA, 22 nt, Human herpesvirus 4
gcaggguugcugaggccggggu

SEQ ID NO: 4959 - RNA, 22 nt, Human herpesvirus 4
ccgagggccuuagaggccaagg

SEQ ID NO: 4960 - RNA, 22 nt, Human herpesvirus 4
uuagagaguugugggagcgguu

SEQ ID NO: 4961 - RNA, 20 nt, Human herpesvirus 4
uugcugaccugcgcggcggg

SEQ ID NO: 4962 - RNA, 22 nt, Human herpesvirus 4
ucgugucagcggucucuggccc

SEQ ID NO: 4963 - RNA, 22 nt, Human herpesvirus 4
ucuggaagcccgccgccaccug

SEQ ID NO: 4964 - RNA, 22 nt, Human herpesvirus 4
gaaggaagcagggugccagcuc

SEQ ID NO: 4965 - RNA, 22 nt, Human herpesvirus 4
gcuuggucaggaucaccuugcu

SEQ ID NO: 4966 - RNA, 22 nt, Human herpesvirus 4
cggagggucucagaggaucgcc

SEQ ID NO: 4967 - RNA, 22 nt, Human herpesvirus 4
ccgggcgaucccccuccacuuc

SEQ ID NO: 4968 - RNA, 22 nt, Human herpesvirus 4
cggagggucucagaggaucgcc

SEQ ID NO: 4969 - RNA, 22 nt, Human herpesvirus 4
ccgggcgaucccccuccacuuc

SEQ ID NO: 4970 - RNA, 22 nt, Human herpesvirus 4
cggagggucucagaggaucgcc

SEQ ID NO: 4971 - RNA, 22 nt, Human herpesvirus 4
ccgggcgaucccccuccacuuc

SEQ ID NO: 4972 - RNA, 22 nt, Human herpesvirus 4
cggagggucucagaggaucgcc

SEQ ID NO: 4973 - RNA, 22 nt, Human herpesvirus 4
ccgggcgaucccccuccacuuc

SEQ ID NO: 4974 - RNA, 22 nt, Human herpesvirus 4
cggagggucucagaggaucgcc

SEQ ID NO: 4975 - RNA, 22 nt, Human herpesvirus 4
ccgggcgaucccccuccacuuc

SEQ ID NO: 4976 - RNA, 22 nt, Human herpesvirus 4
cggagggucucagaggaucgcc

SEQ ID NO: 4977 - RNA, 22 nt, Human herpesvirus 4
ccgggcgaucccccuccacuuc

SEQ ID NO: 4978 - RNA, 22 nt, Human herpesvirus 4
ugauauguuugucccccaugua

SEQ ID NO: 4979 - RNA, 21 nt, Human herpesvirus 4
augauggcggcagauaaagca

SEQ ID NO: 4980 - RNA, 22 nt, Human herpesvirus 4
ccauaaaugaaacacgcugguc

SEQ ID NO: 4981 - RNA, 18 nt, Human herpesvirus 4
ucccagauuuucgugagg

SEQ ID NO: 4982 - RNA, 22 nt, Human herpesvirus 4
ucugguuguugccguugacccc

SEQ ID NO: 4983 - RNA, 22 nt, Human herpesvirus 4
cuggcagcgugacaaccggacg

SEQ ID NO: 4984 - RNA, 22 nt, Human herpesvirus 4
gcauccacguuggccucaaaga

SEQ ID NO: 4985 - RNA, 17 nt, Human herpesvirus 4
ucuugcagccacguggc

SEQ ID NO: 4986 - RNA, 22 nt, Human herpesvirus 4
uguccccagcggggccagcgcg

SEQ ID NO: 4987 - RNA, 22 nt, Human herpesvirus 4
ccuggcccucuuuguggacggg

SEQ ID NO: 4988 - RNA, 22 nt, Human herpesvirus 4
ucuuccaugcucaugucaacag

SEQ ID NO: 4989 - RNA, 22 nt, Human herpesvirus 4
ucugacuuugcguggagcugac

SEQ ID NO: 4990 - RNA, 22 nt, Human herpesvirus 4
ucccccgccuccagcaccggga

SEQ ID NO: 4991 - RNA, 22 nt, Human herpesvirus 4
ucgaguacgacugugagguggg

SEQ ID NO: 4992 - RNA, 22 nt, Human herpesvirus 4
agcagcuuggaagaggaaauua

SEQ ID NO: 4993 - RNA, 20 nt, Human herpesvirus 4
uaugucccacaucagguucu

SEQ ID NO: 4994 - RNA, 22 nt, Human herpesvirus 4
uccgugggacuaaucauaaagc

SEQ ID NO: 4995 - RNA, 21 nt, Human herpesvirus 4
uggcggaugcguccccgcaga

SEQ ID NO: 4996 - RNA, 22 nt, Human herpesvirus 4
aaacuugggccagcccgggggg

SEQ ID NO: 4997 - RNA, 22 nt, Human herpesvirus 4
ccccaguuugccccaucguuuc

SEQ ID NO: 4998 - RNA, 22 nt, Human herpesvirus 4
ucggcucggaaaggcuguauga

SEQ ID NO: 4999 - RNA, 19 nt, Human herpesvirus 4
uauacagcuucucggccac

SEQ ID NO: 5000 - RNA, 22 nt, Human herpesvirus 4
cgcggccccggccuccgcggcc

SEQ ID NO: 5001 - RNA, 20 nt, Human herpesvirus 4
ccccggccuccgcggccccg

SEQ ID NO: 5002 - RNA, 22 nt, Human herpesvirus 4
cccagagaacccagcugagaug

SEQ ID NO: 5003 - RNA, 19 nt, Human herpesvirus 4
gugcuccgguauucauagg

SEQ ID NO: 5004 - RNA, 22 nt, Human herpesvirus 4
cccaaugaacauggauguugag

SEQ ID NO: 5005 - RNA, 21 nt, Human herpesvirus 4
aacaauauguuuucagagagg

SEQ ID NO: 5006 - RNA, 22 nt, Human herpesvirus 4
cccgacuaucgacccugcauuu

SEQ ID NO: 5007 - RNA, 17 nt, Human herpesvirus 4
ugacggggauggugagg

SEQ ID NO: 5008 - RNA, 22 nt, Human herpesvirus 4
cacgcucgaggcggacagcuuc

SEQ ID NO: 5009 - RNA, 20 nt, Human herpesvirus 4
gcaugagcagcccgaguaug

SEQ ID NO: 5010 - RNA, 22 nt, Human herpesvirus 4
uacgauaaucucacagguggcc

SEQ ID NO: 5011 - RNA, 20 nt, Human herpesvirus 4
agaguccuggagcuccauua

SEQ ID NO: 5012 - RNA, 22 nt, Human herpesvirus 4
ucuggguagcauaugcuauccu

SEQ ID NO: 5013 - RNA, 20 nt, Human herpesvirus 4
guaguauaugcuauccuaau

SEQ ID NO: 5014 - RNA, 22 nt, Human herpesvirus 4
ucuggguagcauaugcuauccu

SEQ ID NO: 5015 - RNA, 20 nt, Human herpesvirus 4
guagcauaggcuauccuaau

SEQ ID NO: 5016 - RNA, 22 nt, Human herpesvirus 4
gccucugcguccggaguggcuc

SEQ ID NO: 5017 - RNA, 22 nt, Human herpesvirus 4
gcccaccacccccaaggccaag

SEQ ID NO: 5018 - RNA, 22 nt, Human herpesvirus 4
uggcggugcuggugacacccgu

SEQ ID NO: 5019 - RNA, 22 nt, Human herpesvirus 4
ucauccguaagaccuugagcac

SEQ ID NO: 5020 - RNA, 22 nt, Human herpesvirus 4
cagguuggcggggcucagggcc

SEQ ID NO: 5021 - RNA, 22 nt, Human herpesvirus 4
ccuuggcccgcuccaacaucgu

SEQ ID NO: 5022 - RNA, 22 nt, Human herpesvirus 4
uuggugacgcggacguaugagg

SEQ ID NO: 5023 - RNA, 22 nt, Human herpesvirus 4
ucguacuuccacacgccucuca

SEQ ID NO: 5024 - RNA, 22 nt, Human herpesvirus 4
ucacccucggggaccccuggac

SEQ ID NO: 5025 - RNA, 22 nt, Human herpesvirus 4
uugggggcgcccgggggucggg

SEQ ID NO: 5026 - RNA, 22 nt, Human herpesvirus 4
ucacccucggggaccccuggac

SEQ ID NO: 5027 - RNA, 22 nt, Human herpesvirus 4
uugggggcgcccgggggucggg

SEQ ID NO: 5028 - RNA, 22 nt, Human herpesvirus 4
ucacccucggggaccccuggac

SEQ ID NO: 5029 - RNA, 22 nt, Human herpesvirus 4
uugggggcgcccgggggucggg

SEQ ID NO: 5030 - RNA, 22 nt, Human herpesvirus 4
ucacccucggggaccccuggac

SEQ ID NO: 5031 - RNA, 22 nt, Human herpesvirus 4
uugggggcgcccgggggucggg

SEQ ID NO: 5032 - RNA, 22 nt, Human herpesvirus 4
ucacccucggggaccccuggac

SEQ ID NO: 5033 - RNA, 22 nt, Human herpesvirus 4
uugggggcgcccgggggucggg

SEQ ID NO: 5034 - RNA, 22 nt, Human herpesvirus 4
ucacccucggggaccccuggac

SEQ ID NO: 5035 - RNA, 22 nt, Human herpesvirus 4
uugggggcgcccgggggucggg

SEQ ID NO: 5036 - RNA, 22 nt, Human herpesvirus 4
cggggccgcggaggccggggcc

SEQ ID NO: 5037 - RNA, 20 nt, Human herpesvirus 4
ccgcggaggccggggccgcg

SEQ ID NO: 5038 - RNA, 22 nt, Human herpesvirus 4
aggucucugaugagcuggaaga

SEQ ID NO: 5039 - RNA, 17 nt, Human herpesvirus 4
cagcuccgaugggaacu

SEQ ID NO: 5040 - RNA, 22 nt, Human herpesvirus 4
ugugucgguggacaaugacguu

SEQ ID NO: 5041 - RNA, 22 nt, Human herpesvirus 4
ccccgaaucccgccgacaagcg

SEQ ID NO: 5042 - RNA, 22 nt, Human herpesvirus 4
gcggcugauggcgggggcugcu

SEQ ID NO: 5043 - RNA, 21 nt, Human herpesvirus 4
uggagaaggagccggggcggc

SEQ ID NO: 5044 - RNA, 22 nt, Human herpesvirus 4
ugauuccuagaggcgaugagac

SEQ ID NO: 5045 - RNA, 22 nt, Human herpesvirus 4
ugucauggccacaaugggguug

SEQ ID NO: 5046 - RNA, 22 nt, Human herpesvirus 4
cggcggggggucgggguccgcg

SEQ ID NO: 5047 - RNA, 21 nt, Human herpesvirus 4
ugcgggcgguggauggcggcg

SEQ ID NO: 5048 - RNA, 22 nt, Human herpesvirus 4
gagcacacguuguuuuggcaau

SEQ ID NO: 5049 - RNA, 20 nt, Human herpesvirus 4
uugcuuuugcucuggguauc

SEQ ID NO: 5050 - RNA, 22 nt, Human herpesvirus 4
cagccugacucuggggucucac

SEQ ID NO: 5051 - RNA, 22 nt, Human herpesvirus 4
aucaauaggucccagguucaug

SEQ ID NO: 5052 - RNA, 22 nt, Human herpesvirus 4
ugcugccccugaagaugccgga

SEQ ID NO: 5053 - RNA, 20 nt, Human herpesvirus 4
gucugucuggggggcugagg

SEQ ID NO: 5054 - RNA, 22 nt, Human herpesvirus 4
ccguuccucauuuugugugccu

SEQ ID NO: 5055 - RNA, 12 nt, Human herpesvirus 4
ccacaggggagg

SEQ ID NO: 5056 - RNA, 22 nt, Human herpesvirus 4
augaccccuggagguggcugug

SEQ ID NO: 5057 - RNA, 22 nt, Human herpesvirus 4
ugguggcaauugugaggggggu

SEQ ID NO: 5058 - RNA, 22 nt, Human herpesvirus 4
uuucauuggaauuauuuugaga

SEQ ID NO: 5059 - RNA, 22 nt, Human herpesvirus 4
ucaauuuuaauuuuaaaauuuu

SEQ ID NO: 5060 - RNA, 22 nt, Human herpesvirus 4
cgucuagguugucacuucgcuc

SEQ ID NO: 5061 - RNA, 20 nt, Human herpesvirus 4
gcgcaaguccaagucuggug

SEQ ID NO: 5062 - RNA, 22 nt, Human herpesvirus 4
gcuggcgugagacugggcccag

SEQ ID NO: 5063 - RNA, 22 nt, Human herpesvirus 4
ucgggaccgucacacagcuuug

SEQ ID NO: 5064 - RNA, 22 nt, Human herpesvirus 4
uguacauccagcugcuguaugc

SEQ ID NO: 5065 - RNA, 22 nt, Human herpesvirus 4
auccggcggccaggguuugcag

SEQ ID NO: 5066 - RNA, 22 nt, Human herpesvirus 4
uguaggcaauugcgugccuaga

SEQ ID NO: 5067 - RNA, 22 nt, Human herpesvirus 4
ugcccuggguuuccugccuuca

SEQ ID NO: 5068 - RNA, 22 nt, Human herpesvirus 4
aauuucugccgcaaaagauaac

SEQ ID NO: 5069 - RNA, 18 nt, Human herpesvirus 4
ucugcugcaacagaauuu

SEQ ID NO: 5070 - RNA, 22 nt, Human herpesvirus 4
gcugggccaccagaucucgcuu

SEQ ID NO: 5071 - RNA, 21 nt, Human herpesvirus 4
uucauaagucaccauguccgc

SEQ ID NO: 5072 - RNA, 22 nt, Human herpesvirus 4
cauacucgggcugcucaugccc

SEQ ID NO: 5073 - RNA, 22 nt, Human herpesvirus 4
gaagcuguccgccucgagcgug

SEQ ID NO: 5074 - RNA, 22 nt, Human herpesvirus 4
ucuaucucauuaccgagcauuu

SEQ ID NO: 5075 - RNA, 19 nt, Human herpesvirus 4
aauucgagucuugagcuga

SEQ ID NO: 5076 - RNA, 22 nt, Human herpesvirus 4
cguccggcuuucccauccccca

SEQ ID NO: 5077 - RNA, 21 nt, Human herpesvirus 4
ggguccggcuuggccgccccg

SEQ ID NO: 5078 - RNA, 22 nt, Human herpesvirus 4
ucgggggcuucgucgcgugacc

SEQ ID NO: 5079 - RNA, 22 nt, Human herpesvirus 4
gagccgugugaaagccccgccg

SEQ ID NO: 5080 - RNA, 22 nt, Human herpesvirus 4
gcuccugccccuccugccccuc

SEQ ID NO: 5081 - RNA, 21 nt, Human herpesvirus 4
uccugccccuccugcuccugc

SEQ ID NO: 5082 - RNA, 22 nt, Human herpesvirus 4
ugguguguguuuacagggauua

SEQ ID NO: 5083 - RNA, 22 nt, Human herpesvirus 4
uagggguacccgaggcacagca

SEQ ID NO: 5084 - RNA, 22 nt, Human herpesvirus 4
uucgucgggcucaacuccgcag

SEQ ID NO: 5085 - RNA, 22 nt, Human herpesvirus 4
uggcucgagggccugucgcagc

SEQ ID NO: 5086 - RNA, 22 nt, Human herpesvirus 4
uggaagcuuuccgaaauucgga

SEQ ID NO: 5087 - RNA, 22 nt, Human herpesvirus 4
caauuucccgaagagcuucugg

SEQ ID NO: 5088 - RNA, 22 nt, Human herpesvirus 4
gcuugggcugugguaaccggug

SEQ ID NO: 5089 - RNA, 21 nt, Human herpesvirus 4
uccagcggggccgcaguuugc

SEQ ID NO: 5090 - RNA, 22 nt, Human herpesvirus 4
uuaacauuggcagcagguaagc

SEQ ID NO: 5091 - RNA, 22 nt, Human herpesvirus 4
uugccuuuuugccacauguuuu

SEQ ID NO: 5092 - RNA, 22 nt, Human herpesvirus 4
agcuucugggaaacacuguuuc

SEQ ID NO: 5093 - RNA, 19 nt, Human herpesvirus 4
cguauuucccgcggggcag

SEQ ID NO: 5094 - RNA, 22 nt, Human herpesvirus 4
agggcggccuugcgaacaauua

SEQ ID NO: 5095 - RNA, 16 nt, Human herpesvirus 4
ggcccccagaugcccc

SEQ ID NO: 5096 - RNA, 22 nt, Human herpesvirus 4
aaggcuguaugacuuccuuaag

SEQ ID NO: 5097 - RNA, 19 nt, Human herpesvirus 4
cuguucuuauacagcuucu

SEQ ID NO: 5098 - RNA, 22 nt, Human herpesvirus 4
augggcaggacaaggcccuggu

SEQ ID NO: 5099 - RNA, 20 nt, Human herpesvirus 4
ccugcacguccugccacgcc

SEQ ID NO: 5100 - RNA, 22 nt, Human herpesvirus 4
agcauggacaucucuccgucuu

SEQ ID NO: 5101 - RNA, 10 nt, Human herpesvirus 4
gagucaugcc

SEQ ID NO: 5102 - RNA, 22 nt, Human herpesvirus 4
uaccugucggcccugcgcuacu

SEQ ID NO: 5103 - RNA, 20 nt, Human herpesvirus 4
uauguggggcgcagcgggaa

SEQ ID NO: 5104 - RNA, 22 nt, Human herpesvirus 4
aagaugucuaugauggagaggc

SEQ ID NO: 5105 - RNA, 22 nt, Human herpesvirus 4
cuccacgcuguuucaugcugag

SEQ ID NO: 5106 - RNA, 22 nt, Human herpesvirus 4
auggcaggcccugcccucaggc

SEQ ID NO: 5107 - RNA, 22 nt, Human herpesvirus 4
cuguucaagaggaggguggcca

SEQ ID NO: 5108 - RNA, 22 nt, Human herpesvirus 4
agcauucuguagguuaaacgcg

SEQ ID NO: 5109 - RNA, 20 nt, Human herpesvirus 4
ucuuguuuacgauccaugcc

SEQ ID NO: 5110 - RNA, 22 nt, Human herpesvirus 4
aaugacucggguguguccuugu

SEQ ID NO: 5111 - RNA, 22 nt, Human herpesvirus 4
uggaauaacacccagacauaag

SEQ ID NO: 5112 - RNA, 22 nt, Human herpesvirus 4
uacaggucgcguaggucuaugg

SEQ ID NO: 5113 - RNA, 21 nt, Human herpesvirus 4
ugguggauugcugaacugggg

SEQ ID NO: 5114 - RNA, 22 nt, Human herpesvirus 4
uagucggaggccaccggcauag

SEQ ID NO: 5115 - RNA, 16 nt, Human herpesvirus 4
ugcccggccagggcca

SEQ ID NO: 5116 - RNA, 22 nt, Human herpesvirus 4
aggaggccccgcggcaggaggc

SEQ ID NO: 5117 - RNA, 20 nt, Human herpesvirus 4
ccccgcggcaggaggccccg

SEQ ID NO: 5118 - RNA, 22 nt, Human herpesvirus 4
accaccguggugauuuuauuca

SEQ ID NO: 5119 - RNA, 20 nt, Human herpesvirus 4
auauucuccaccagggggcc

SEQ ID NO: 5120 - RNA, 22 nt, Human herpesvirus 4
agccucaccuguucuccuccug

SEQ ID NO: 5121 - RNA, 22 nt, Human herpesvirus 4
gguagaauugccaccuggugag

SEQ ID NO: 5122 - RNA, 22 nt, Human herpesvirus 4
uauugcucucguugccaaaacc

SEQ ID NO: 5123 - RNA, 21 nt, Human herpesvirus 4
gcacccgcaacauggggaaaa

SEQ ID NO: 5124 - RNA, 22 nt, Human herpesvirus 4
aauggaggggccguugguacca

SEQ ID NO: 5125 - RNA, 22 nt, Human herpesvirus 4
ucccuggugcccccuuuagcca

SEQ ID NO: 5126 - RNA, 22 nt, Human herpesvirus 4
aaggagaggccaggggagaggg

SEQ ID NO: 5127 - RNA, 18 nt, Human herpesvirus 4
ugccggggucccuccggc

SEQ ID NO: 5128 - RNA, 22 nt, Human herpesvirus 4
aaagggaaguuuaccugguaca

SEQ ID NO: 5129 - RNA, 15 nt, Human herpesvirus 4
ucaagaaccccuacc

SEQ ID NO: 5130 - RNA, 22 nt, Human herpesvirus 4
aagugguccugcagcuauuucu

SEQ ID NO: 5131 - RNA, 15 nt, Human herpesvirus 4
ggaguccacacaaau

SEQ ID NO: 5132 - RNA, 22 nt, Human herpesvirus 4
aagacagggaaaggccaucgga

SEQ ID NO: 5133 - RNA, 22 nt, Human herpesvirus 4
gcggcccgagcccagaagguug

SEQ ID NO: 5134 - RNA, 22 nt, Human herpesvirus 4
aacaccagugggcacaacuagc

SEQ ID NO: 5135 - RNA, 21 nt, Human herpesvirus 4
uaguugccuucacuagugaau

SEQ ID NO: 5136 - RNA, 22 nt, Human herpesvirus 4
aaacucuccggguagccggcac

SEQ ID NO: 5137 - RNA, 22 nt, Human herpesvirus 4
ccccuuuacccugcccagggga

SEQ ID NO: 5138 - RNA, 22 nt, Human herpesvirus 4
uaagccucccuuuaugugagcc

SEQ ID NO: 5139 - RNA, 22 nt, Human herpesvirus 4
cuuaccccugaaggugaaccgc

SEQ ID NO: 5140 - RNA, 22 nt, Human herpesvirus 4
uaagccucccuuuaugugagcc

SEQ ID NO: 5141 - RNA, 22 nt, Human herpesvirus 4
cuuaccccugaaggugaaccgc

SEQ ID NO: 5142 - RNA, 22 nt, Human herpesvirus 4
uaaacuuacaucacguguaugu

SEQ ID NO: 5143 - RNA, 18 nt, Human herpesvirus 4
auacagauuagaggggca

SEQ ID NO: 5144 - RNA, 22 nt, Human herpesvirus 4
aaaauucuauuguguugggaga

SEQ ID NO: 5145 - RNA, 21 nt, Human herpesvirus 4
gccuuuccucacaauacaaau

SEQ ID NO: 5146 - RNA, 22 nt, Human herpesvirus 4
uaaccaauaucaucucagccag

SEQ ID NO: 5147 - RNA, 22 nt, Human herpesvirus 4
uuaccuauugaugaggaugaga

SEQ ID NO: 5148 - RNA, 22 nt, Human herpesvirus 4
aaugaguccggugaaggugacg

SEQ ID NO: 5149 - RNA, 20 nt, Human herpesvirus 4
ggcuuccuuccgaauuuugu

SEQ ID NO: 5150 - RNA, 22 nt, Human herpesvirus 4
aaucgagcggggguggaggggc

SEQ ID NO: 5151 - RNA, 22 nt, Human herpesvirus 4
ucagacuccucgucuucgcucu

SEQ ID NO: 5152 - RNA, 22 nt, Human herpesvirus 4
acaacuuaugucuggguguuau

SEQ ID NO: 5153 - RNA, 18 nt, Human herpesvirus 4
acccgagucauugcuccg

SEQ ID NO: 5154 - RNA, 22 nt, Human herpesvirus 4
acauaccccaaaccaccgcaga

SEQ ID NO: 5155 - RNA, 15 nt, Human herpesvirus 4
ugucuaucugugccc

SEQ ID NO: 5156 - RNA, 22 nt, Human herpesvirus 4
accuucaucaccgucgcugacu

SEQ ID NO: 5157 - RNA, 14 nt, Human herpesvirus 4
agaccgaagugaag

SEQ ID NO: 5158 - RNA, 22 nt, Human herpesvirus 4
accaggcaugauguagaauaaa

SEQ ID NO: 5159 - RNA, 22 nt, Human herpesvirus 4
aucaucuucuaaucugugccgc

SEQ ID NO: 5160 - RNA, 22 nt, Human herpesvirus 4
acccccacagugccgccagucc

SEQ ID NO: 5161 - RNA, 20 nt, Human herpesvirus 4
uuccccaccggcgcugcccc

SEQ ID NO: 5162 - RNA, 22 nt, Human herpesvirus 4
acuccgccagcucaucgccgcu

SEQ ID NO: 5163 - RNA, 15 nt, Human herpesvirus 4
auagcaugguggccu

SEQ ID NO: 5164 - RNA, 22 nt, Human herpesvirus 4
agcuccacgcaaagucagauug

SEQ ID NO: 5165 - RNA, 21 nt, Human herpesvirus 4
cuguugacaugagcauggaag

SEQ ID NO: 5166 - RNA, 22 nt, Human herpesvirus 4
agcucuuccgcuucaucugggc

SEQ ID NO: 5167 - RNA, 20 nt, Human herpesvirus 4
gcccacgguggcggcagacc

SEQ ID NO: 5168 - RNA, 22 nt, Human herpesvirus 4
agguggcagccuguuuauagau

SEQ ID NO: 5169 - RNA, 19 nt, Human herpesvirus 4
ucugcuuuagggcugccag

SEQ ID NO: 5170 - RNA, 22 nt, Human herpesvirus 4
agucucuuuucccucuucccuu

SEQ ID NO: 5171 - RNA, 20 nt, Human herpesvirus 4
uuacagugagguuacacagg

SEQ ID NO: 5172 - RNA, 22 nt, Human herpesvirus 4
auggaggccaucucgugaugca

SEQ ID NO: 5173 - RNA, 20 nt, Human herpesvirus 4
guccacccuggccucccggc

SEQ ID NO: 5174 - RNA, 22 nt, Human herpesvirus 4
uauaccccaaagcauccagcug

SEQ ID NO: 5175 - RNA, 20 nt, Human herpesvirus 4
agugccuuggcuaggggggg

SEQ ID NO: 5176 - RNA, 22 nt, Human herpesvirus 4
uauacuauucugccacgcccau

SEQ ID NO: 5177 - RNA, 15 nt, Human herpesvirus 4
ugagcuggccugacg

SEQ ID NO: 5178 - RNA, 22 nt, Human herpesvirus 4
aucccuauggccuaagugugug

SEQ ID NO: 5179 - RNA, 20 nt, Human herpesvirus 4
ucacacaacaacaagguaag

SEQ ID NO: 5180 - RNA, 22 nt, Human herpesvirus 4
augucugugguguuugucggca

SEQ ID NO: 5181 - RNA, 19 nt, Human herpesvirus 4
uggaaucucaucagagaac

SEQ ID NO: 5182 - RNA, 22 nt, Human herpesvirus 4
uauuugugccuuucgaaaugcg

SEQ ID NO: 5183 - RNA, 17 nt, Human herpesvirus 4
ugccucuccgcgcguga

SEQ ID NO: 5184 - RNA, 22 nt, Human herpesvirus 4
ccggcuguggccgcaggggucg

SEQ ID NO: 5185 - RNA, 22 nt, Human herpesvirus 4
cccgggugccgaucucagccgc

SEQ ID NO: 5186 - RNA, 22 nt, Human herpesvirus 4
caggggcgcgacugaccuggca

SEQ ID NO: 5187 - RNA, 20 nt, Human herpesvirus 4
cagcaagcuccgcuuccuag

SEQ ID NO: 5188 - RNA, 22 nt, Human herpesvirus 4
cggcccagaaggguacgaagag

SEQ ID NO: 5189 - RNA, 16 nt, Human herpesvirus 4
gaugccggugggucag

SEQ ID NO: 5190 - RNA, 22 nt, Human herpesvirus 4
ccacccacuggccccccuugau

SEQ ID NO: 5191 - RNA, 20 nt, Human herpesvirus 4
ugucuggggagagggugccg

SEQ ID NO: 5192 - RNA, 22 nt, Human herpesvirus 4
cuagggaacugaggagggcaug

SEQ ID NO: 5193 - RNA, 21 nt, Human herpesvirus 4
ugcaacuugaggcagccuaau

SEQ ID NO: 5194 - RNA, 22 nt, Human herpesvirus 4
cguccgcccggcgcaggaucaa

SEQ ID NO: 5195 - RNA, 19 nt, Human herpesvirus 4
ucuuguuguagagggacac

SEQ ID NO: 5196 - RNA, 22 nt, Human herpesvirus 4
caauaaccgaggccuucaagga

SEQ ID NO: 5197 - RNA, 12 nt, Human herpesvirus 4
ugguggccauuc

SEQ ID NO: 5198 - RNA, 22 nt, Human herpesvirus 4
cgggcaagggcuucuugcgggc

SEQ ID NO: 5199 - RNA, 21 nt, Human herpesvirus 4
cgcaucaccggccucaucccc

SEQ ID NO: 5200 - RNA, 22 nt, Human herpesvirus 4
cucggcgcucuggccuaagaag

SEQ ID NO: 5201 - RNA, 22 nt, Human herpesvirus 4
cugacaaggcgagagcgggacg

SEQ ID NO: 5202 - RNA, 22 nt, Human herpesvirus 4
cggcugggcuaaugauguccgc

SEQ ID NO: 5203 - RNA, 17 nt, Human herpesvirus 4
gacgaagcccugcucac

SEQ ID NO: 5204 - RNA, 22 nt, Human herpesvirus 4
cggaagggcucagagugcccgu

SEQ ID NO: 5205 - RNA, 19 nt, Human herpesvirus 4
gagcaacgacccugaccug

SEQ ID NO: 5206 - RNA, 22 nt, Human herpesvirus 4
cagaaacaggaggagccaaagg

SEQ ID NO: 5207 - RNA, 21 nt, Human herpesvirus 4
uagaguccaccaguuuuguug

SEQ ID NO: 5208 - RNA, 22 nt, Human herpesvirus 4
cagagguagacgaggcacaggc

SEQ ID NO: 5209 - RNA, 19 nt, Human herpesvirus 4
uguugcuucagagccuuau

SEQ ID NO: 5210 - RNA, 22 nt, Human herpesvirus 4
cagguggccguaggugucacgu

SEQ ID NO: 5211 - RNA, 22 nt, Human herpesvirus 4
ggcaccuuuaagcugccgcgau

SEQ ID NO: 5212 - RNA, 22 nt, Human herpesvirus 4
cagacgucgaggcauacugccg

SEQ ID NO: 5213 - RNA, 20 nt, Human herpesvirus 4
gccaaacggcgcgcgcggau

SEQ ID NO: 5214 - RNA, 22 nt, Human herpesvirus 4
cauuuucccaaucucccgccga

SEQ ID NO: 5215 - RNA, 20 nt, Human herpesvirus 4
cgagguagaugggacuucuu

SEQ ID NO: 5216 - RNA, 22 nt, Human herpesvirus 4
ccgcacggacccggcuggcucu

SEQ ID NO: 5217 - RNA, 22 nt, Human herpesvirus 4
auuauccucgcuagucugugca

SEQ ID NO: 5218 - RNA, 22 nt, Human herpesvirus 4
uccgcgcgcgccguuuggccgg

SEQ ID NO: 5219 - RNA, 21 nt, Human herpesvirus 4
ggcaguaugccucgacgucug

SEQ ID NO: 5220 - RNA, 22 nt, Human herpesvirus 4
ccgcugacagggcuggaacgga

SEQ ID NO: 5221 - RNA, 21 nt, Human herpesvirus 4
ucccuucgggcagcagcccuc

SEQ ID NO: 5222 - RNA, 22 nt, Human herpesvirus 4
cccuggcggcugacagaccuug

SEQ ID NO: 5223 - RNA, 22 nt, Human herpesvirus 4
gugaacagcggcccaccgguuu

SEQ ID NO: 5224 - RNA, 22 nt, Human herpesvirus 4
ccucgaguaggugccuccagag

SEQ ID NO: 5225 - RNA, 21 nt, Human herpesvirus 4
uggcggcccagcccgaccccc

SEQ ID NO: 5226 - RNA, 22 nt, Human herpesvirus 4
cccgcgcggcgccccccgaccc

SEQ ID NO: 5227 - RNA, 22 nt, Human herpesvirus 4
gaacguccgccgccauccaccg

SEQ ID NO: 5228 - RNA, 22 nt, Human herpesvirus 4
cccgcgcggcgccccccgaccc

SEQ ID NO: 5229 - RNA, 22 nt, Human herpesvirus 4
gaacguccgccgccauccaccg

SEQ ID NO: 5230 - RNA, 22 nt, Human herpesvirus 4
uuuugucuccccucugcagaga

SEQ ID NO: 5231 - RNA, 22 nt, Human herpesvirus 4
ucgaagcggucucagacaccaa

SEQ ID NO: 5232 - RNA, 22 nt, Human herpesvirus 4
ccagaggcgacgcuccuggguu

SEQ ID NO: 5233 - RNA, 17 nt, Human herpesvirus 4
ggucgcgcguccagauc

SEQ ID NO: 5234 - RNA, 22 nt, Human herpesvirus 4
ccccguccguaaagaauagacu

SEQ ID NO: 5235 - RNA, 20 nt, Human herpesvirus 4
gucucuuucaccacguacuu

SEQ ID NO: 5236 - RNA, 22 nt, Human herpesvirus 4
cccccuccaacagcccccccac

SEQ ID NO: 5237 - RNA, 19 nt, Human herpesvirus 4
gucgcugucagacagaucc

SEQ ID NO: 5238 - RNA, 22 nt, Human herpesvirus 4
ccgaugaugaugacaaccgcgg

SEQ ID NO: 5239 - RNA, 15 nt, Human herpesvirus 4
guugagauucugaug

SEQ ID NO: 5240 - RNA, 22 nt, Human herpesvirus 4
ccuggcguggaaguuaaugucc

SEQ ID NO: 5241 - RNA, 22 nt, Human herpesvirus 4
auucuggcccccaacgccucug

SEQ ID NO: 5242 - RNA, 22 nt, Human herpesvirus 4
cgacccccgggcgcccccaaac

SEQ ID NO: 5243 - RNA, 20 nt, Human herpesvirus 4
cagggguccccgagggugag

SEQ ID NO: 5244 - RNA, 22 nt, Human herpesvirus 4
cgcugaaaccaacggcaacaaa

SEQ ID NO: 5245 - RNA, 22 nt, Human herpesvirus 4
uguuguugugugauggguaaaa

SEQ ID NO: 5246 - RNA, 22 nt, Human herpesvirus 4
cggcccuuagaagacuuuagcc

SEQ ID NO: 5247 - RNA, 18 nt, Human herpesvirus 4
ugcggucguggagggaag

SEQ ID NO: 5248 - RNA, 22 nt, Human herpesvirus 4
cguagcagucacaaggaccggg

SEQ ID NO: 5249 - RNA, 20 nt, Human herpesvirus 4
ccugacucaaaacuguuuac

SEQ ID NO: 5250 - RNA, 22 nt, Human herpesvirus 4
cguuccagaugagaggcagcca

SEQ ID NO: 5251 - RNA, 22 nt, Human herpesvirus 4
gucuuccucucuggacacuggu

SEQ ID NO: 5252 - RNA, 22 nt, Human herpesvirus 4
uaccacgugaugcaguacucgu

SEQ ID NO: 5253 - RNA, 22 nt, Human herpesvirus 4
agcccgccugccccaucuucac

SEQ ID NO: 5254 - RNA, 22 nt, Human herpesvirus 4
ucaaguucgcacuuccuauaca

SEQ ID NO: 5255 - RNA, 22 nt, Human herpesvirus 4
uaucggaaguuugggcuucguc

SEQ ID NO: 5256 - RNA, 22 nt, Human herpesvirus 4
ucuccuguuacccuuuuagaac

SEQ ID NO: 5257 - RNA, 18 nt, Human herpesvirus 4
agacgccuuggccucuaa

SEQ ID NO: 5258 - RNA, 22 nt, Human herpesvirus 4
ucuccuucccgccucccacccg

SEQ ID NO: 5259 - RNA, 21 nt, Human herpesvirus 4
gccuccccaccggguccauca

SEQ ID NO: 5260 - RNA, 22 nt, Human herpesvirus 4
cucuaacuggguucaugggggc

SEQ ID NO: 5261 - RNA, 22 nt, Human herpesvirus 4
cacgugugacccauguuuccau

SEQ ID NO: 5262 - RNA, 22 nt, Human herpesvirus 4
uguggacuggggugcgggugcg

SEQ ID NO: 5263 - RNA, 22 nt, Human herpesvirus 4
uacggaugaucaccccgagucc

SEQ ID NO: 5264 - RNA, 22 nt, Human herpesvirus 4
ugacccggggcuccggggugac

SEQ ID NO: 5265 - RNA, 18 nt, Human herpesvirus 4
caaggggcccguggguga

SEQ ID NO: 5266 - RNA, 22 nt, Human herpesvirus 4
ugacccggggcuccggggugac

SEQ ID NO: 5267 - RNA, 18 nt, Human herpesvirus 4
caaggggcccguggguga

SEQ ID NO: 5268 - RNA, 22 nt, Human herpesvirus 4
ugacccggggcuccggggugac

SEQ ID NO: 5269 - RNA, 18 nt, Human herpesvirus 4
caaggggcccguggguga

SEQ ID NO: 5270 - RNA, 22 nt, Human herpesvirus 4
gaggaaggggaagaaacugcaa

SEQ ID NO: 5271 - RNA, 20 nt, Human herpesvirus 4
ccaacaugucccuuuccugu

SEQ ID NO: 5272 - RNA, 22 nt, Human herpesvirus 4
gccccgucauagaucucccaga

SEQ ID NO: 5273 - RNA, 19 nt, Human herpesvirus 4
gcucgagaggacggcgggc

SEQ ID NO: 5274 - RNA, 22 nt, Human herpesvirus 4
gccccaucguucuacgcaggac

SEQ ID NO: 5275 - RNA, 21 nt, Human herpesvirus 4
ggcucuagcgagagauggggg

SEQ ID NO: 5276 - RNA, 22 nt, Human herpesvirus 4
ggggucccuccggccggccuga

SEQ ID NO: 5277 - RNA, 19 nt, Human herpesvirus 4
gcaagcugagggggcucgg

SEQ ID NO: 5278 - RNA, 22 nt, Human herpesvirus 4
ggggucccuccggccggccuga

SEQ ID NO: 5279 - RNA, 19 nt, Human herpesvirus 4
gcaagcugagggggcucgg

SEQ ID NO: 5280 - RNA, 22 nt, Human herpesvirus 4
gugcacagacuagcgaggauaa

SEQ ID NO: 5281 - RNA, 21 nt, Human herpesvirus 4
agccagccggguccgugcggc

SEQ ID NO: 5282 - RNA, 22 nt, Human herpesvirus 4
ggcggaagcccucgucaggccg

SEQ ID NO: 5283 - RNA, 22 nt, Human herpesvirus 4
caucgaggauggccuccgcaau

SEQ ID NO: 5284 - RNA, 22 nt, Human herpesvirus 4
ggccgugcgcucagucaucugg

SEQ ID NO: 5285 - RNA, 22 nt, Human herpesvirus 4
augaucucucuggcuguaagcg

SEQ ID NO: 5286 - RNA, 22 nt, Human herpesvirus 4
guuuacugugccuggcuccuaa

SEQ ID NO: 5287 - RNA, 19 nt, Human herpesvirus 4
ccccgaggacauugugaag

SEQ ID NO: 5288 - RNA, 22 nt, Human herpesvirus 4
gugguaggugaucuccuggagc

SEQ ID NO: 5289 - RNA, 21 nt, Human herpesvirus 4
ucuucuagcauggccaccagg

SEQ ID NO: 5290 - RNA, 22 nt, Human herpesvirus 4
gaggucagaaccagaugcuucu

SEQ ID NO: 5291 - RNA, 18 nt, Human herpesvirus 4
agcuuugucucccgccuu

SEQ ID NO: 5292 - RNA, 22 nt, Human herpesvirus 4
guggacuaguuggaucacugga

SEQ ID NO: 5293 - RNA, 20 nt, Human herpesvirus 4
uucacauccacaaaucuagg

SEQ ID NO: 5294 - RNA, 22 nt, Human herpesvirus 4
guagguguugaggaauuucaug

SEQ ID NO: 5295 - RNA, 22 nt, Human herpesvirus 4
ugauguaguucucccuccuggu

SEQ ID NO: 5296 - RNA, 22 nt, Human herpesvirus 4
ggccacuggaacgccccuuuuc

SEQ ID NO: 5297 - RNA, 19 nt, Human herpesvirus 4
gugacccguucucgggcgu

SEQ ID NO: 5298 - RNA, 22 nt, Human herpesvirus 4
gccgcguccaacaacucccgga

SEQ ID NO: 5299 - RNA, 21 nt, Human herpesvirus 4
ucccccgaguuugacccggag

SEQ ID NO: 5300 - RNA, 22 nt, Human herpesvirus 4
ugugaacuuucuaugggcuggg

SEQ ID NO: 5301 - RNA, 22 nt, Human herpesvirus 4
agcauccaucaccgagagggcg

SEQ ID NO: 5302 - RNA, 22 nt, Human herpesvirus 4
gcgcuugcucgcguuccugccg

SEQ ID NO: 5303 - RNA, 22 nt, Human herpesvirus 4
ggagaauggccgcgaguuuuuu

SEQ ID NO: 5304 - RNA, 22 nt, Human herpesvirus 4
gaugggggcgccuggggccgag

SEQ ID NO: 5305 - RNA, 21 nt, Human herpesvirus 4
ggcccaacauugccucgaugu

SEQ ID NO: 5306 - RNA, 22 nt, Human herpesvirus 4
gccuccuaucccuggcggaggc

SEQ ID NO: 5307 - RNA, 22 nt, Human herpesvirus 4
cguggccagacaacaggcuggg

SEQ ID NO: 5308 - RNA, 22 nt, Human herpesvirus 4
ugaugccucuggagcuggggau

SEQ ID NO: 5309 - RNA, 20 nt, Human herpesvirus 4
auuuggcccagccggugcug

SEQ ID NO: 5310 - RNA, 22 nt, Human herpesvirus 4
gaccuuucuauucccagggaaa

SEQ ID NO: 5311 - RNA, 21 nt, Human herpesvirus 4
ucugaacgcauugugagggau

SEQ ID NO: 5312 - RNA, 22 nt, Human herpesvirus 4
gauacuguuagcccuguguaua

SEQ ID NO: 5313 - RNA, 22 nt, Human herpesvirus 4
ugcauggaaaugguacccugca

SEQ ID NO: 5314 - RNA, 22 nt, Human herpesvirus 4
gaccccucguggcauccuucag

SEQ ID NO: 5315 - RNA, 22 nt, Human herpesvirus 4
acuacagcgagagcgacgagga

SEQ ID NO: 5316 - RNA, 22 nt, Human herpesvirus 4
gagcccgagaugccgcacgggg

SEQ ID NO: 5317 - RNA, 20 nt, Human herpesvirus 4
ccgucguuaucuuggagaau

SEQ ID NO: 5318 - RNA, 22 nt, Human herpesvirus 4
gagcugcaccggagccugccgg

SEQ ID NO: 5319 - RNA, 21 nt, Human herpesvirus 4
ccagaucacggcugucuagac

SEQ ID NO: 5320 - RNA, 22 nt, Human herpesvirus 4
gauacgggcgccagagucacag

SEQ ID NO: 5321 - RNA, 15 nt, Human herpesvirus 4
ccuggcgucacgcac

SEQ ID NO: 5322 - RNA, 22 nt, Human herpesvirus 4
uacagccagcucccugaggagc

SEQ ID NO: 5323 - RNA, 22 nt, Human herpesvirus 4
cccggaccgcuggcgagccgag

SEQ ID NO: 5324 - RNA, 22 nt, Human herpesvirus 4
gccugcggaaggauuuggacaa

SEQ ID NO: 5325 - RNA, 22 nt, Human herpesvirus 4
ucaaacggaagaaaucaauucg

SEQ ID NO: 5326 - RNA, 22 nt, Human herpesvirus 4
gcaaaacucuaggccuguggag

SEQ ID NO: 5327 - RNA, 12 nt, Human herpesvirus 4
ccgggccuggac

SEQ ID NO: 5328 - RNA, 22 nt, Human herpesvirus 4
cccuggagcugggauacagccu

SEQ ID NO: 5329 - RNA, 22 nt, Human herpesvirus 4
cgucgccuaccgguuccgggau

SEQ ID NO: 5330 - RNA, 22 nt, Human herpesvirus 4
gccugaggugggcaucagggcg

SEQ ID NO: 5331 - RNA, 22 nt, Human herpesvirus 4
ugaaaagcccaucccucacaau

SEQ ID NO: 5332 - RNA, 22 nt, Human herpesvirus 4
ugcugggaccucgggugcccgc

SEQ ID NO: 5333 - RNA, 22 nt, Human herpesvirus 4
ggccccuggacuggucucucaa

SEQ ID NO: 5334 - RNA, 22 nt, Human herpesvirus 4
ugcugggaccucgggugcccgc

SEQ ID NO: 5335 - RNA, 22 nt, Human herpesvirus 4
ggccccuggacuggucucucaa

SEQ ID NO: 5336 - RNA, 22 nt, Human herpesvirus 4
ugcugggaccucgggugcccgc

SEQ ID NO: 5337 - RNA, 22 nt, Human herpesvirus 4
ggccccuggacuggucucucaa

SEQ ID NO: 5338 - RNA, 22 nt, Human herpesvirus 4
gcugccggcuaagaccaccgcc

SEQ ID NO: 5339 - RNA, 16 nt, Human herpesvirus 4
uaugcggcagccggau

SEQ ID NO: 5340 - RNA, 22 nt, Human herpesvirus 4
ggccaucuggaccaaagaaguc

SEQ ID NO: 5341 - RNA, 20 nt, Human herpesvirus 4
ucagcuaccagaccuggaag

SEQ ID NO: 5342 - RNA, 22 nt, Human herpesvirus 4
uggcauuugggguugggguagu

SEQ ID NO: 5343 - RNA, 20 nt, Human herpesvirus 4
uuguuuuucccaaggugggg

SEQ ID NO: 5344 - RNA, 22 nt, Human herpesvirus 4
ggauuggccgcccccaucacuc

SEQ ID NO: 5345 - RNA, 18 nt, Human herpesvirus 4
auggcaaggcccuauuuc

SEQ ID NO: 5346 - RNA, 22 nt, Human herpesvirus 4
ggagagaggagugaauaccgcg

SEQ ID NO: 5347 - RNA, 20 nt, Human herpesvirus 4
acgggucacucugcuugaau

SEQ ID NO: 5348 - RNA, 22 nt, Human herpesvirus 4
uggaacaggcgggcgaaugugu

SEQ ID NO: 5349 - RNA, 19 nt, Human herpesvirus 4
aggcgacgcugcgccugag

SEQ ID NO: 5350 - RNA, 22 nt, Human herpesvirus 4
ggugccugaugcggauguguug

SEQ ID NO: 5351 - RNA, 20 nt, Human herpesvirus 4
caacguacacguagagggag

SEQ ID NO: 5352 - RNA, 22 nt, Human herpesvirus 4
gugggggguaaagaaggugaau

SEQ ID NO: 5353 - RNA, 18 nt, Human herpesvirus 4
ucucugcccagccuucag

SEQ ID NO: 5354 - RNA, 22 nt, Human herpesvirus 4
ugcaacggggcagggggagggu

SEQ ID NO: 5355 - RNA, 21 nt, Human herpesvirus 4
cgccucucugcccuguuugcc

SEQ ID NO: 5356 - RNA, 22 nt, Human herpesvirus 4
ucaggguggcuacuugcucagg

SEQ ID NO: 5357 - RNA, 22 nt, Human herpesvirus 4
ugggcauaaauucuccugccug

SEQ ID NO: 5358 - RNA, 22 nt, Human herpesvirus 4
ugugccuggcucuguccagaau

SEQ ID NO: 5359 - RNA, 22 nt, Human herpesvirus 4
acguuguagccggucacaaucu

SEQ ID NO: 5360 - RNA, 22 nt, Human herpesvirus 4
ugcggguuccaauugugaccca

SEQ ID NO: 5361 - RNA, 21 nt, Human herpesvirus 4
uaccaguaaucaaaccugccu

SEQ ID NO: 5362 - RNA, 22 nt, Human herpesvirus 4
uacuccacggaccuccagacgc

SEQ ID NO: 5363 - RNA, 22 nt, Human herpesvirus 4
ucguggagggcauccaggaugu

SEQ ID NO: 5364 - RNA, 22 nt, Human herpesvirus 4
uuuccacuugaggugucugaug

SEQ ID NO: 5365 - RNA, 21 nt, Human herpesvirus 4
acuggaugauuaaaugggauu

SEQ ID NO: 5366 - RNA, 22 nt, Human herpesvirus 4
ugggucucagugacauggaaga

SEQ ID NO: 5367 - RNA, 17 nt, Human herpesvirus 4
uauguuauguuggccug

SEQ ID NO: 5368 - RNA, 22 nt, Human herpesvirus 4
ugaagauguaaaauuuacaccu

SEQ ID NO: 5369 - RNA, 21 nt, Human herpesvirus 4
ugccuuuuguacaagcuuuug

SEQ ID NO: 5370 - RNA, 22 nt, Human herpesvirus 4
ucauuuccucuuagaagguaau

SEQ ID NO: 5371 - RNA, 17 nt, Human herpesvirus 4
ccuuuaaauugugaugc

SEQ ID NO: 5372 - RNA, 22 nt, Human herpesvirus 4
ugccaccgugaaguuagagucc

SEQ ID NO: 5373 - RNA, 21 nt, Human herpesvirus 4
cauuguuuuccccauggugcu

SEQ ID NO: 5374 - RNA, 22 nt, Human herpesvirus 4
ucuccugauuugcucuucgugc

SEQ ID NO: 5375 - RNA, 17 nt, Human herpesvirus 4
gcaagauccuucuggca

SEQ ID NO: 5376 - RNA, 22 nt, Human herpesvirus 4
ucaguguugucaggguccugag

SEQ ID NO: 5377 - RNA, 18 nt, Human herpesvirus 4
gccauugucaucaguguu

SEQ ID NO: 5378 - RNA, 22 nt, Human herpesvirus 4
ugaugagguccuggcccgcggc

SEQ ID NO: 5379 - RNA, 22 nt, Human herpesvirus 4
gcaggcuguugcuccuucuccu

SEQ ID NO: 5380 - RNA, 22 nt, Human herpesvirus 4
uacgguaguuccaguggaggcu

SEQ ID NO: 5381 - RNA, 17 nt, Human herpesvirus 4
cguccaccauauaucuu

SEQ ID NO: 5382 - RNA, 22 nt, Human herpesvirus 4
uacuuguuaaggaacacggucu

SEQ ID NO: 5383 - RNA, 20 nt, Human herpesvirus 4
ggcugacguccaccccaccc

SEQ ID NO: 5384 - RNA, 22 nt, Human herpesvirus 4
uaucgaggugcccaaguugagu

SEQ ID NO: 5385 - RNA, 20 nt, Human herpesvirus 4
agauacccuggcgccgaaca

SEQ ID NO: 5386 - RNA, 22 nt, Human herpesvirus 4
ucaacggcccccacguccugag

SEQ ID NO: 5387 - RNA, 22 nt, Human herpesvirus 4
gggccagugaaggccucguaug

SEQ ID NO: 5388 - RNA, 22 nt, Human herpesvirus 4
ucaagaagcugcuggcggccug

SEQ ID NO: 5389 - RNA, 17 nt, Human herpesvirus 4
cucgacaagcagcagcu

SEQ ID NO: 5390 - RNA, 22 nt, Human herpesvirus 4
ucacgcgggcgagccccccguc

SEQ ID NO: 5391 - RNA, 21 nt, Human herpesvirus 4
uggcugggcgucugccccucc

SEQ ID NO: 5392 - RNA, 22 nt, Human herpesvirus 4
uccgcauguuuugauccaaacu

SEQ ID NO: 5393 - RNA, 22 nt, Human herpesvirus 4
uuuaggauuuaugcauccauua

SEQ ID NO: 5394 - RNA, 22 nt, Human herpesvirus 4
uccgccgccaucaaaaugcugg

SEQ ID NO: 5395 - RNA, 21 nt, Human herpesvirus 4
gcagcuaccgguggaggcaug

SEQ ID NO: 5396 - RNA, 22 nt, Human herpesvirus 4
ucgcucacgccccucguggaac

SEQ ID NO: 5397 - RNA, 11 nt, Human herpesvirus 4
acagggggaug

SEQ ID NO: 5398 - RNA, 22 nt, Human herpesvirus 4
ucgugccugggccugcaauuua

SEQ ID NO: 5399 - RNA, 21 nt, Human herpesvirus 4
ugcagaaugcccaccagaucg

SEQ ID NO: 5400 - RNA, 22 nt, Human herpesvirus 4
ucuuggagaccucggugcucua

SEQ ID NO: 5401 - RNA, 22 nt, Human herpesvirus 4
ccuuggggcucugggcgcucuu

SEQ ID NO: 5402 - RNA, 22 nt, Human herpesvirus 4
uguggugugcuuuccaccggug

SEQ ID NO: 5403 - RNA, 20 nt, Human herpesvirus 4
accuguugaggugaccgugg

SEQ ID NO: 5404 - RNA, 22 nt, Human herpesvirus 4
ugauguucugugcaguaaccuu

SEQ ID NO: 5405 - RNA, 20 nt, Human herpesvirus 4
guggaugcguuggaaguugu

SEQ ID NO: 5406 - RNA, 22 nt, Human herpesvirus 4
ugaaccuccugaaucacugcau

SEQ ID NO: 5407 - RNA, 20 nt, Human herpesvirus 4
gaagagaauaguggccaggg

SEQ ID NO: 5408 - RNA, 22 nt, Human herpesvirus 4
uuaucauccuccucauuaccau

SEQ ID NO: 5409 - RNA, 22 nt, Human herpesvirus 4
ucucaacagaggccccaacaug

SEQ ID NO: 5410 - RNA, 22 nt, Human herpesvirus 4
ugcugagcauggccccccagga

SEQ ID NO: 5411 - RNA, 22 nt, Human herpesvirus 4
uggaccaggcggccguuucaaa

SEQ ID NO: 5412 - RNA, 22 nt, Human herpesvirus 4
uugccugggauggggagcggag

SEQ ID NO: 5413 - RNA, 22 nt, Human herpesvirus 4
gcugucuucuaugcccgaguac

SEQ ID NO: 5414 - RNA, 22 nt, Human herpesvirus 4
uugacccccgugauaggggucc

SEQ ID NO: 5415 - RNA, 22 nt, Human herpesvirus 4
ccaaaauaaccaccuuaauauc

SEQ ID NO: 5416 - RNA, 22 nt, Human herpesvirus 4
uuugucuuugccaaccugcucu

SEQ ID NO: 5417 - RNA, 22 nt, Human herpesvirus 4
aucuucucaccguggcagacac

SEQ ID NO: 5418 - RNA, 22 nt, Human herpesvirus 4
ugcgaauugcgcuggccuggaa

SEQ ID NO: 5419 - RNA, 22 nt, Human herpesvirus 4
uauaggucaggccuugcaaaua

SEQ ID NO: 5420 - RNA, 22 nt, Human herpesvirus 4
uuaaucuuuagugggaacuagu

SEQ ID NO: 5421 - RNA, 14 nt, Human herpesvirus 4
cuauagguccuacc

SEQ ID NO: 5422 - RNA, 22 nt, Human herpesvirus 4
uuacaguggccucauuggaggc

SEQ ID NO: 5423 - RNA, 21 nt, Human herpesvirus 4
ucucucggccuacaaccgcca

SEQ ID NO: 5424 - RNA, 22 nt, Human herpesvirus 4
uuacaugcacugccccgcggga

SEQ ID NO: 5425 - RNA, 13 nt, Human herpesvirus 4
cgaaacaguguuu

SEQ ID NO: 5426 - RNA, 22 nt, Human herpesvirus 4
uuuacauagagggucuccguca

SEQ ID NO: 5427 - RNA, 22 nt, Human herpesvirus 4
uggucaccuucagguguuugug

SEQ ID NO: 5428 - RNA, 22 nt, Human herpesvirus 4
uuucuauucuugagugugaaag

SEQ ID NO: 5429 - RNA, 20 nt, Human herpesvirus 4
ucauaaaaugucacuaauuc

SEQ ID NO: 5430 - RNA, 22 nt, Human papillomavirus
cauaugggucugcagccauuug

SEQ ID NO: 5431 - RNA, 20 nt, Human papillomavirus
uacauguagugccacauaug

SEQ ID NO: 5432 - RNA, 22 nt, Human papillomavirus
ggcaaugcaaauuuguuaggau

SEQ ID NO: 5433 - RNA, 22 nt, Human papillomavirus
cuuaaauacccuguauugauau

SEQ ID NO: 5434 - RNA, 22 nt, Human papillomavirus
ugucccugggcuuuuuguagcc

SEQ ID NO: 5435 - RNA, 22 nt, Human papillomavirus
cuuauuaaacaauugugccuca

SEQ ID NO: 5436 - RNA, 22 nt, Human papillomavirus
uguagacauuauaaacaugcag

SEQ ID NO: 5437 - RNA, 22 nt, Human papillomavirus
ugucuauaaaacaauggauaaa

SEQ ID NO: 5438 - RNA, 22 nt, Human papillomavirus
uguauaccaaacaguaagagca

SEQ ID NO: 5439 - RNA, 22 nt, Human papillomavirus
cuuuuaagaguuggcuacagug

SEQ ID NO: 5440 - RNA, 22 nt, Human papillomavirus
ugguaggggguauuuuuacaac

SEQ ID NO: 5441 - RNA, 21 nt, Human papillomavirus
ugccuuuguuccucacuauca

SEQ ID NO: 5442 - RNA, 22 nt, Human papillomavirus
uaccuguacgaaaccaauacag

SEQ ID NO: 5443 - RNA, 22 nt, Human papillomavirus
ucuauuaacauuugguuuucag

SEQ ID NO: 5444 - RNA, 22 nt, Human papillomavirus
ugcaccuauuguaauuuguaua

SEQ ID NO: 5445 - RNA, 21 nt, Human papillomavirus
uaaauauaugguauuggugua

SEQ ID NO: 5446 - RNA, 22 nt, Human papillomavirus
aguggguaugacaugguggacu

SEQ ID NO: 5447 - RNA, 19 nt, Human papillomavirus
auauuacacacaauucacu

SEQ ID NO: 5448 - RNA, 22 nt, Human papillomavirus
uauauguguguauguacuguua

SEQ ID NO: 5449 - RNA, 21 nt, Human papillomavirus
guuguauauauguguguauau

SEQ ID NO: 5450 - RNA, 22 nt, Human papillomavirus
uaaaucauacucuuccacauga

SEQ ID NO: 5451 - RNA, 22 nt, Human papillomavirus
uguauguggaagauguaguuac

SEQ ID NO: 5452 - RNA, 22 nt, Human papillomavirus
aguaugguagaugcuaagggua

SEQ ID NO: 5453 - RNA, 22 nt, Human papillomavirus
cacauguggacaauuuaaaaca

SEQ ID NO: 5454 - RNA, 22 nt, Human papillomavirus
ccuccuagaaagcuuauuaaac

SEQ ID NO: 5455 - RNA, 20 nt, Human papillomavirus
gauuucccaguaucuggagg

SEQ ID NO: 5456 - RNA, 22 nt, Human papillomavirus
uguuagcaucauugcugugugg

SEQ ID NO: 5457 - RNA, 22 nt, Human papillomavirus
uauaguaguguauauacaaugc

SEQ ID NO: 5458 - RNA, 22 nt, Human papillomavirus
ccugcaccuggugcaaugcacg

SEQ ID NO: 5459 - RNA, 18 nt, Human papillomavirus
ugcaguaccaggaacagg

SEQ ID NO: 5460 - RNA, 22 nt, Human papillomavirus
gcaccgaagaccuaacaacgau

SEQ ID NO: 5461 - RNA, 22 nt, Human papillomavirus
agaaaaugaggggucugggugu

SEQ ID NO: 5462 - RNA, 22 nt, Human papillomavirus
uccucugaggcacaauuguuua

SEQ ID NO: 5463 - RNA, 19 nt, Human papillomavirus
cuacaaaaagcccagggac

SEQ ID NO: 5464 - RNA, 22 nt, Human papillomavirus
uacaugcgucauguggaagagu

SEQ ID NO: 5465 - RNA, 21 nt, Human papillomavirus
uuuucaauuauguagcauuac

SEQ ID NO: 5466 - RNA, 22 nt, Human papillomavirus
ugaaauugcauuugaauaugca

SEQ ID NO: 5467 - RNA, 20 nt, Human papillomavirus
uugauucuaaugcacgagca

SEQ ID NO: 5468 - RNA, 22 nt, Human papillomavirus
uggcaggauaugaugcacuugg

SEQ ID NO: 5469 - RNA, 20 nt, Human papillomavirus
agggcaauguguaccuggca

SEQ ID NO: 5470 - RNA, 22 nt, Human papillomavirus
uugaugauauuaaaucaaauaa

SEQ ID NO: 5471 - RNA, 16 nt, Human papillomavirus
uagccuauaucuaaaa

SEQ ID NO: 5472 - RNA, 22 nt, Human papillomavirus
ugaugauuauguaacuaugcau

SEQ ID NO: 5473 - RNA, 20 nt, Human papillomavirus
gugauuauauauauaugaau

SEQ ID NO: 5474 - RNA, 22 nt, Human papillomavirus
uugcacagaccugccauugcgu

SEQ ID NO: 5475 - RNA, 21 nt, Human papillomavirus
acaacgggggucuaugcacac

SEQ ID NO: 5476 - RNA, 22 nt, Human papillomavirus
aucuuccacauacaccaauucu

SEQ ID NO: 5477 - RNA, 22 nt, Human papillomavirus
guacaugcgucauguggaagag

SEQ ID NO: 5478 - RNA, 22 nt, Human papillomavirus
aauaaaucucugcuguggucag

SEQ ID NO: 5479 - RNA, 17 nt, Human papillomavirus
cacaauuaauuugcaac

SEQ ID NO: 5480 - RNA, 22 nt, Human papillomavirus
caggguguaacaagagguaauu

SEQ ID NO: 5481 - RNA, 22 nt, Human papillomavirus
acacauacacauuacacaaaua

SEQ ID NO: 5482 - RNA, 22 nt, Human papillomavirus
ugugcauagacccccguugucc

SEQ ID NO: 5483 - RNA, 19 nt, Human papillomavirus
aauggcaggucugugcaaa

SEQ ID NO: 5484 - RNA, 22 nt, Human papillomavirus
uaccauuugggggaggcgauaa

SEQ ID NO: 5485 - RNA, 21 nt, Human papillomavirus
ucuuccaaaacagagggauuc

SEQ ID NO: 5486 - RNA, 22 nt, Human papillomavirus
uaacaggguguuggguaggguu

SEQ ID NO: 5487 - RNA, 22 nt, Human papillomavirus
cagguucaaaagauucagcaua

SEQ ID NO: 5488 - RNA, 22 nt, Human papillomavirus
ugaaccgcgccuugguuaguau

SEQ ID NO: 5489 - RNA, 18 nt, Human papillomavirus
cuucacacagcgguuugu

SEQ ID NO: 5490 - RNA, 22 nt, Human papillomavirus
uuaacaccuguacgaauagagg

SEQ ID NO: 5491 - RNA, 22 nt, Human papillomavirus
uauauccacuuuguaacaaaaa

SEQ ID NO: 5492 - RNA, 22 nt, Human papillomavirus
aaggugucuaaguuuuucugcu

SEQ ID NO: 5493 - RNA, 14 nt, Human papillomavirus
accgcaggcaccuu

SEQ ID NO: 5494 - RNA, 22 nt, Human papillomavirus
gcuguauuaguguuuuaaaucc

SEQ ID NO: 5495 - RNA, 18 nt, Human papillomavirus
guuuacuccaaauauagc

SEQ ID NO: 5496 - RNA, 22 nt, Human papillomavirus
uacaucuggaacacauggguau

SEQ ID NO: 5497 - RNA, 22 nt, Human papillomavirus
uacaaacauuugcuucuucugg

SEQ ID NO: 5498 - RNA, 22 nt, Human papillomavirus
ccuugcacaaagucgauacaaa

SEQ ID NO: 5499 - RNA, 20 nt, Human papillomavirus
acugcaagacacaugcgagg

SEQ ID NO: 5500 - RNA, 22 nt, Human papillomavirus
ccaaaaaaaauuguuuaguauu

SEQ ID NO: 5501 - RNA, 21 nt, Human papillomavirus
uacaggaaaaucauauuuugg

SEQ ID NO: 5502 - RNA, 22 nt, Human papillomavirus
uaggaccaacauccaccacugu

SEQ ID NO: 5503 - RNA, 17 nt, Human papillomavirus
aauggaauguacccugu

SEQ ID NO: 5504 - RNA, 22 nt, Human papillomavirus
uuuucgcaaucuguaccguaaa

SEQ ID NO: 5505 - RNA, 22 nt, Human papillomavirus
ucugucaccuuuuaaauguauu

SEQ ID NO: 5506 - RNA, 22 nt, Human papillomavirus
ggauauuugucagucuauuugu

SEQ ID NO: 5507 - RNA, 20 nt, Human papillomavirus
uuacaaaugucugcagaucc

SEQ ID NO: 5508 - RNA, 22 nt, Human papillomavirus
uauccacucaggugugucuccc

SEQ ID NO: 5509 - RNA, 16 nt, Human papillomavirus
uauuccuguucuauac

SEQ ID NO: 5510 - RNA, 22 nt, Human papillomavirus
gcccuagugaguaacaacugua

SEQ ID NO: 5511 - RNA, 21 nt, Human papillomavirus
uauggguguugcuuguugggc

SEQ ID NO: 5512 - RNA, 22 nt, Human papillomavirus
uuugauuugucagaaaugguac

SEQ ID NO: 5513 - RNA, 20 nt, Human papillomavirus
uaaugagcugacagaugaaa

SEQ ID NO: 5514 - RNA, 22 nt, Human papillomavirus
uuaguaucugccacggaggaca

SEQ ID NO: 5515 - RNA, 22 nt, Human papillomavirus
uuugauauauaugcagaugaca

SEQ ID NO: 5516 - RNA, 22 nt, Human papillomavirus
uauuagugaaguaaugggagac

SEQ ID NO: 5517 - RNA, 20 nt, Human papillomavirus
auacaaagacuuacuauuau

SEQ ID NO: 5518 - RNA, 22 nt, Human papillomavirus
ucauauuauaguucauguuaag

SEQ ID NO: 5519 - RNA, 16 nt, Human papillomavirus
caugaaaguaguugua

SEQ ID NO: 5520 - RNA, 22 nt, Human papillomavirus
acauaugggcuaucauuuacag

SEQ ID NO: 5521 - RNA, 22 nt, Human papillomavirus
uuaaaagugauaaaaccacgug

SEQ ID NO: 5522 - RNA, 22 nt, Human papillomavirus
gguuccucccccguaccagaag

SEQ ID NO: 5523 - RNA, 20 nt, Human papillomavirus
uaaagguauuuccucauacc

SEQ ID NO: 5524 - RNA, 22 nt, Human papillomavirus
uguuggauccucaaagcgcgcc

SEQ ID NO: 5525 - RNA, 21 nt, Human papillomavirus
uguguuucucacaucuuuuau

SEQ ID NO: 5526 - RNA, 22 nt, Human papillomavirus
acuuucuaaauauggccaucua

SEQ ID NO: 5527 - RNA, 20 nt, Human papillomavirus
gauguauauuugugguuagu

SEQ ID NO: 5528 - RNA, 22 nt, Human papillomavirus
aacauauugguacuacagcaua

SEQ ID NO: 5529 - RNA, 22 nt, Human papillomavirus
ugucauguaucccaccaauauu

SEQ ID NO: 5530 - RNA, 22 nt, Human papillomavirus
ucuccaaguggcucuauuguua

SEQ ID NO: 5531 - RNA, 22 nt, Human papillomavirus
uuuaauaaaccauauugguuac

SEQ ID NO: 5532 - RNA, 22 nt, Human papillomavirus
uguaaccacacuggaguccucu

SEQ ID NO: 5533 - RNA, 21 nt, Human papillomavirus
uagaugggucuguggggccca

SEQ ID NO: 5534 - RNA, 22 nt, Human papillomavirus
aaucuaccauauccgacccugu

SEQ ID NO: 5535 - RNA, 20 nt, Human papillomavirus
ucguccucgucaucugauau

SEQ ID NO: 5536 - RNA, 22 nt, Human papillomavirus
acagcugcuggaaugcucgaag

SEQ ID NO: 5537 - RNA, 22 nt, Human papillomavirus
agcuuucuacuacuagcucaau

SEQ ID NO: 5538 - RNA, 22 nt, Human papillomavirus
aacaauuuuuuuuggggguucc

SEQ ID NO: 5539 - RNA, 22 nt, Human papillomavirus
ggcuccuaaaaauguuauaaac

SEQ ID NO: 5540 - RNA, 22 nt, Human papillomavirus
uauuaccugucaaaaggaugcu

SEQ ID NO: 5541 - RNA, 18 nt, Human papillomavirus
ucccuaugauaaguuaaa

SEQ ID NO: 5542 - RNA, 22 nt, Human papillomavirus
cuaugguacauuguggauuuac

SEQ ID NO: 5543 - RNA, 21 nt, Human papillomavirus
auugucacuuguaccgucuac

SEQ ID NO: 5544 - RNA, 22 nt, Human papillomavirus
uacccuuaacaugaacuauaau

SEQ ID NO: 5545 - RNA, 22 nt, Human papillomavirus
uacauaguuuaugcaaccgaaa

SEQ ID NO: 5546 - RNA, 22 nt, Human papillomavirus
gaaaacgguguauauaaaagau

SEQ ID NO: 5547 - RNA, 21 nt, Human papillomavirus
aauacuauggcgcgcuuugag

SEQ ID NO: 5548 - RNA, 22 nt, Human papillomavirus
ugauccagaagguacagacggg

SEQ ID NO: 5549 - RNA, 15 nt, Human papillomavirus
ugguuuuauguacaa

SEQ ID NO: 5550 - RNA, 22 nt, Human papillomavirus
uucaggcuggauugcgucgcaa

SEQ ID NO: 5551 - RNA, 20 nt, Human papillomavirus
cccucgcaaacguucugcuc

SEQ ID NO: 5552 - RNA, 22 nt, Human papillomavirus
uugagaaaaaggauuuccaguu

SEQ ID NO: 5553 - RNA, 20 nt, Human papillomavirus
uggauuuccguuuucgucaa

SEQ ID NO: 5554 - RNA, 22 nt, Human papillomavirus
ucuauaucuuaaacauuuuaaa

SEQ ID NO: 5555 - RNA, 17 nt, Human papillomavirus
uuaaauguacuaugggu

SEQ ID NO: 5556 - RNA, 22 nt, Human papillomavirus
uaguucauacaugaacugugua

SEQ ID NO: 5557 - RNA, 21 nt, Human papillomavirus
cauuguucauuuguaaaacug

SEQ ID NO: 5558 - RNA, 22 nt, Human papillomavirus
uacagaccuacgugaccauaua

SEQ ID NO: 5559 - RNA, 13 nt, Human papillomavirus
gccuagaaugugc

SEQ ID NO: 5560 - RNA, 22 nt, Human papillomavirus
acaguuaauccguccuuugugu

SEQ ID NO: 5561 - RNA, 20 nt, Human papillomavirus
agugaggauuggagcacugu

SEQ ID NO: 5562 - RNA, 22 nt, Human papillomavirus
uaccaauauuauuaaugaugug

SEQ ID NO: 5563 - RNA, 21 nt, Human papillomavirus
agacaaaagcagcggacguau

SEQ ID NO: 5564 - RNA, 22 nt, Human papillomavirus
cauaacugugguaacuuucugg

SEQ ID NO: 5565 - RNA, 22 nt, Human papillomavirus
ccugaaacauugcaguucucuu

SEQ ID NO: 5566 - RNA, 22 nt, Human papillomavirus
cagguaauauuauguccuacau

SEQ ID NO: 5567 - RNA, 21 nt, Human papillomavirus
gcaacgaaguauccucuccug

SEQ ID NO: 5568 - RNA, 22 nt, Human papillomavirus
uguuuuauuguauauauuauau

SEQ ID NO: 5569 - RNA, 22 nt, Human papillomavirus
uaccauuauuuuuaauacauac

SEQ ID NO: 5570 - RNA, 22 nt, Human papillomavirus
ucuauaggugcuaagguacauu

SEQ ID NO: 5571 - RNA, 22 nt, Human papillomavirus
uuuaaguacuauugauccugca

SEQ ID NO: 5572 - RNA, 22 nt, Human papillomavirus
uguaagcacggaugaauauguu

SEQ ID NO: 5573 - RNA, 22 nt, Human papillomavirus
cauauauuaucaugcaggaaca

SEQ ID NO: 5574 - RNA, 22 nt, Human papillomavirus
acaaaaugggccuggcgcuaca

SEQ ID NO: 5575 - RNA, 21 nt, Human papillomavirus
uauaaaacaaaaacaggaugu

SEQ ID NO: 5576 - RNA, 22 nt, Human papillomavirus
gcuaacacagguaaaucauuau

SEQ ID NO: 5577 - RNA, 20 nt, Human papillomavirus
augaaauuucugcaaggguc

SEQ ID NO: 5578 - RNA, 22 nt, Human papillomavirus
uaugguauaauaaacacgugug

SEQ ID NO: 5579 - RNA, 22 nt, Human papillomavirus
cuuguguaacuauugugucaug

SEQ ID NO: 5580 - RNA, 22 nt, Human papillomavirus
aaaucacuaugcgccaacgccu

SEQ ID NO: 5581 - RNA, 20 nt, Human papillomavirus
uaggcacauauuuuuggcuu

SEQ ID NO: 5582 - RNA, 22 nt, Human papillomavirus
ugcaaaggcagcaauguuagca

SEQ ID NO: 5583 - RNA, 20 nt, Human papillomavirus
uauacggggugaguuuuuca

SEQ ID NO: 5584 - RNA, 22 nt, Human papillomavirus
ugucuggcucugaucuuggucg

SEQ ID NO: 5585 - RNA, 22 nt, Human papillomavirus
guuucuucggugcccaaggcga

SEQ ID NO: 5586 - RNA, 22 nt, Human papillomavirus
ugguuggcaagcagugcagguc

SEQ ID NO: 5587 - RNA, 20 nt, Human papillomavirus
uuuggcacgcauggcaagca

SEQ ID NO: 5588 - RNA, 22 nt, Human papillomavirus
acugcuaaacgcaaaaaacgua

SEQ ID NO: 5589 - RNA, 18 nt, Human papillomavirus
uguauguugaauuagugu

SEQ ID NO: 5590 - RNA, 22 nt, Human papillomavirus
uuguaagugguguuuggcauau

SEQ ID NO: 5591 - RNA, 22 nt, Human papillomavirus
aacacccucucccccacuucca

SEQ ID NO: 5592 - RNA, 22 nt, Human papillomavirus
aacuuuuccuuuaaauuuacuu

SEQ ID NO: 5593 - RNA, 22 nt, Human papillomavirus
uguauuuuuuaaggggaucauc

SEQ ID NO: 5594 - RNA, 22 nt, Human papillomavirus
uagcgccaggcccauuuuguag

SEQ ID NO: 5595 - RNA, 13 nt, Human papillomavirus
augcuuuuuggca

SEQ ID NO: 5596 - RNA, 22 nt, Human papillomavirus
cgaaaacggaaauccaguguau

SEQ ID NO: 5597 - RNA, 16 nt, Human papillomavirus
uggaaauccuuuuucu

SEQ ID NO: 5598 - RNA, 22 nt, Human papillomavirus
uguacauuguauacugcagugu

SEQ ID NO: 5599 - RNA, 22 nt, Human papillomavirus
auuggacaggacauaauguaaa

SEQ ID NO: 5600 - RNA, 22 nt, Human papillomavirus
gcagcagcauuauauugguaua

SEQ ID NO: 5601 - RNA, 22 nt, Human papillomavirus
uaucaaauauuagugaagugua

SEQ ID NO: 5602 - RNA, 22 nt, Human papillomavirus
uuguaccaauggucuaugcuuu

SEQ ID NO: 5603 - RNA, 22 nt, Human papillomavirus
uagaaacuaaauuuccauccaa

SEQ ID NO: 5604 - RNA, 22 nt, Human papillomavirus
uugucuuuguauccauucuggc

SEQ ID NO: 5605 - RNA, 20 nt, Human papillomavirus
cuucacuaauauuugauaua

SEQ ID NO: 5606 - RNA, 22 nt, Human papillomavirus
acaauuuuaauuuacuuaaaaa

SEQ ID NO: 5607 - RNA, 22 nt, Human papillomavirus
uuugaugccuuaaaaauuguac

SEQ ID NO: 5608 - RNA, 22 nt, Human papillomavirus
cagggcgugggguggauccuac

SEQ ID NO: 5609 - RNA, 22 nt, Human papillomavirus
uccuaccgccaguaccagagcc

SEQ ID NO: 5610 - RNA, 22 nt, Human papillomavirus
ugucacguuuguuuguacugua

SEQ ID NO: 5611 - RNA, 21 nt, Human papillomavirus
cuguauguguaauguuguaug

SEQ ID NO: 5612 - RNA, 22 nt, Human papillomavirus
uugugucuucugaggcccaguu

SEQ ID NO: 5613 - RNA, 19 nt, Human papillomavirus
aaaaggcccagggacacaa

SEQ ID NO: 5614 - RNA, 22 nt, Human papillomavirus
ccugacacaucuauauuugacu

SEQ ID NO: 5615 - RNA, 22 nt, Human papillomavirus
ucaacgcuuagugugggccugu

SEQ ID NO: 5616 - RNA, 22 nt, Human papillomavirus
uagcagcgaauuagcacaucca

SEQ ID NO: 5617 - RNA, 18 nt, Human papillomavirus
ugucuucuucaacuguua

SEQ ID NO: 5618 - RNA, 22 nt, Human papillomavirus
gcagaaccugacccugacccug

SEQ ID NO: 5619 - RNA, 15 nt, Human papillomavirus
gucauugucuucugc

SEQ ID NO: 5620 - RNA, 22 nt, Human papillomavirus
uguggacgugcauaugucuagu

SEQ ID NO: 5621 - RNA, 20 nt, Human papillomavirus
uauuagauugcaauuccgca

SEQ ID NO: 5622 - RNA, 22 nt, Human papillomavirus
uagaagaauuugauuuacaauu

SEQ ID NO: 5623 - RNA, 22 nt, Human papillomavirus
ugugcacuauuaaauuaacugc

SEQ ID NO: 5624 - RNA, 22 nt, Human papillomavirus
uugugucccugggccuuuugua

SEQ ID NO: 5625 - RNA, 22 nt, Human papillomavirus
aacugggccucagaagacacaa

SEQ ID NO: 5626 - RNA, 22 nt, Human papillomavirus
uguuaugucaggaccaggcugu

SEQ ID NO: 5627 - RNA, 22 nt, Human papillomavirus
ucaccugguagugaaagaggaa

SEQ ID NO: 5628 - RNA, 22 nt, Human papillomavirus
ugcguguucugcaggaaaaccc

SEQ ID NO: 5629 - RNA, 21 nt, Human papillomavirus
gagguuuaugcauuucaguau

SEQ ID NO: 5630 - RNA, 22 nt, Human papillomavirus
uucauuuacauagguuaagguu

SEQ ID NO: 5631 - RNA, 22 nt, Human papillomavirus
uccaaugccauguagaugaugc

SEQ ID NO: 5632 - RNA, 22 nt, Human papillomavirus
uccugcacagccgcauaaugag

SEQ ID NO: 5633 - RNA, 22 nt, Human papillomavirus
ucguuuaacaaugccugugcuu

SEQ ID NO: 5634 - RNA, 22 nt, Human papillomavirus
aauuguuauaacagcauauauu

SEQ ID NO: 5635 - RNA, 16 nt, Human papillomavirus
uguguguguauauauu

SEQ ID NO: 5636 - RNA, 22 nt, Human papillomavirus
uacuaaaacguuuguguacacc

SEQ ID NO: 5637 - RNA, 18 nt, Human papillomavirus
cacaauauuguuauaaug

SEQ ID NO: 5638 - RNA, 22 nt, Human papillomavirus
uguacacaaacguuuuaguacu

SEQ ID NO: 5639 - RNA, 17 nt, Human papillomavirus
uacuuuuguggcuuuua

SEQ ID NO: 5640 - RNA, 22 nt, Human papillomavirus
ccuccugauguuauaccaaagg

SEQ ID NO: 5641 - RNA, 22 nt, Human papillomavirus
ucuugcagauaaaauauuaaag

SEQ ID NO: 5642 - RNA, 22 nt, Human papillomavirus
uuggggcgacgauaaaaaggca

SEQ ID NO: 5643 - RNA, 21 nt, Human papillomavirus
uacuugauguaaggcccuacu

SEQ ID NO: 5644 - RNA, 22 nt, Human papillomavirus
ucaucaaaaguacagguuaaca

SEQ ID NO: 5645 - RNA, 22 nt, Human papillomavirus
uauucuuguguuuguaaaauau

SEQ ID NO: 5646 - RNA, 22 nt, Human papillomavirus
uuuuugcaugagcuuaauuaag

SEQ ID NO: 5647 - RNA, 17 nt, Human papillomavirus
auuaguuauguaaauuc

SEQ ID NO: 5648 - RNA, 22 nt, Human respiratory syncytial virus
ucagauauuuuaugugccaaua

SEQ ID NO: 5649 - RNA, 17 nt, Human respiratory syncytial virus
augagauccagauuuga

SEQ ID NO: 5650 - RNA, 22 nt, Human respiratory syncytial virus
aacuuauuugaguacuagaucu

SEQ ID NO: 5651 - RNA, 20 nt, Human respiratory syncytial virus
ucugggacuucagauaaguu

SEQ ID NO: 5652 - RNA, 22 nt, Human respiratory syncytial virus
cauguuauuaaucacagaagau

SEQ ID NO: 5653 - RNA, 20 nt, Human respiratory syncytial virus
ucacuggguuaauagguaug

SEQ ID NO: 5654 - RNA, 22 nt, Human respiratory syncytial virus
gagauuagaaguauaaaauuca

SEQ ID NO: 5655 - RNA, 22 nt, Human respiratory syncytial virus
aauuuguguuuauuuuuaaugu

SEQ ID NO: 5656 - RNA, 22 nt, Human respiratory syncytial virus
ugcaguauuaauuccuuuuuuu

SEQ ID NO: 5657 - RNA, 22 nt, Human respiratory syncytial virus
agaaaggguaucaaacuuuuaa

SEQ ID NO: 5658 - RNA, 22 nt, Human respiratory syncytial virus
agcucuucauugucccucagcu

SEQ ID NO: 5659 - RNA, 18 nt, Human respiratory syncytial virus
ugaguucagugaggaguu

SEQ ID NO: 5660 - RNA, 22 nt, Human respiratory syncytial virus
ugauugcaguuguuggugugac

SEQ ID NO: 5661 - RNA, 22 nt, Human respiratory syncytial virus
ugaauaugauggcugcaauuau

SEQ ID NO: 5662 - RNA, 22 nt, Human respiratory syncytial virus
uccuaguucauuguuaugacua

SEQ ID NO: 5663 - RNA, 22 nt, Human respiratory syncytial virus
uagugguuugcauggugggaug

SEQ ID NO: 5664 - RNA, 22 nt, Human respiratory syncytial virus
uccugaguaagggaugauuuuu

SEQ ID NO: 5665 - RNA, 17 nt, Human respiratory syncytial virus
uuuuugaauucaguggu

SEQ ID NO: 5666 - RNA, 22 nt, Human respiratory syncytial virus
agacccuaaagcuugaggaucu

SEQ ID NO: 5667 - RNA, 15 nt, Human respiratory syncytial virus
ucagcauuaggguuu

SEQ ID NO: 5668 - RNA, 22 nt, Human respiratory syncytial virus
aacgauguggugaguguuagaa

SEQ ID NO: 5669 - RNA, 22 nt, Human respiratory syncytial virus
uaugacacuaauauauauauug

SEQ ID NO: 5670 - RNA, 22 nt, Human respiratory syncytial virus
uauacaccguuauguugaauug

SEQ ID NO: 5671 - RNA, 16 nt, Human respiratory syncytial virus
auaucucgugauauau

SEQ ID NO: 5672 - RNA, 22 nt, Human respiratory syncytial virus
cauauuuuuugauuuuaggcau

SEQ ID NO: 5673 - RNA, 22 nt, Human respiratory syncytial virus
ugccuugauuucacagggugug

SEQ ID NO: 5674 - RNA, 22 nt, Human respiratory syncytial virus
aacuuacagaaagagauuugau

SEQ ID NO: 5675 - RNA, 14 nt, Human respiratory syncytial virus
uucuaucgugaguu

SEQ ID NO: 5676 - RNA, 22 nt, Human respiratory syncytial virus
uagauaaucaaacucuuagugg

SEQ ID NO: 5677 - RNA, 22 nt, Human respiratory syncytial virus
caauaugguuguauaguuuauc

SEQ ID NO: 5678 - RNA, 22 nt, Human respiratory syncytial virus
uuccucgguguaccucuguacu

SEQ ID NO: 5679 - RNA, 22 nt, Human respiratory syncytial virus
agaagugaggaaauugagucaa

SEQ ID NO: 5680 - RNA, 22 nt, Human respiratory syncytial virus
uagguguuggaucugcaaucgc

SEQ ID NO: 5681 - RNA, 22 nt, Human respiratory syncytial virus
guugcuguaucuaagguccugc

SEQ ID NO: 5682 - RNA, 22 nt, Human respiratory syncytial virus
cagaauuugcuugagaauucua

SEQ ID NO: 5683 - RNA, 22 nt, Human respiratory syncytial virus
gauguauuuuccauugguugau

SEQ ID NO: 5684 - RNA, 22 nt, Human respiratory syncytial virus
uuggaacucuaucacaguugcu

SEQ ID NO: 5685 - RNA, 20 nt, Human respiratory syncytial virus
gcagcuuugcuuguucacaa

SEQ ID NO: 5686 - RNA, 22 nt, Human respiratory syncytial virus
uaggugcaggaccuuagauaca

SEQ ID NO: 5687 - RNA, 20 nt, Human respiratory syncytial virus
gauugcagauccaacaccua

SEQ ID NO: 5688 - RNA, 22 nt, Human respiratory syncytial virus
uauaggagaucauauuguagau

SEQ ID NO: 5689 - RNA, 20 nt, Human respiratory syncytial virus
augaacaaaguggauuauau

SEQ ID NO: 5690 - RNA, 22 nt, Human respiratory syncytial virus
aguuuaucuuuuaagucauggu

SEQ ID NO: 5691 - RNA, 17 nt, Human respiratory syncytial virus
ugaacacagagugaacu

SEQ ID NO: 5692 - RNA, 22 nt, Human respiratory syncytial virus
ugcaguuguuggugugacuuug

SEQ ID NO: 5693 - RNA, 20 nt, Human respiratory syncytial virus
cuaugaauaugauggcugca

SEQ ID NO: 5694 - RNA, 22 nt, Human respiratory syncytial virus
agugaaguaaaucucugcaaug

SEQ ID NO: 5695 - RNA, 22 nt, Human respiratory syncytial virus
uguaaaauuaugacuucaaaaa

SEQ ID NO: 5696 - RNA, 22 nt, Human respiratory syncytial virus
gcaauuaaugauaacaauauua

SEQ ID NO: 5697 - RNA, 22 nt, Human respiratory syncytial virus
uaguaguuaucaugauauuuau

SEQ ID NO: 5698 - RNA, 22 nt, Human respiratory syncytial virus
uuggcacauaaaauaucugacu

SEQ ID NO: 5699 - RNA, 21 nt, Human respiratory syncytial virus
acuuacauuuuaaguacuaau

SEQ ID NO: 5700 - RNA, 22 nt, Human respiratory syncytial virus
uauaacagacuaccugugauuu

SEQ ID NO: 5701 - RNA, 22 nt, Human respiratory syncytial virus
guucauugguugucaagcuguu

SEQ ID NO: 5702 - RNA, 22 nt, Human respiratory syncytial virus
uuaguuuguuggucuucuguug

SEQ ID NO: 5703 - RNA, 20 nt, Human respiratory syncytial virus
augugaagauugguaacuaa

SEQ ID NO: 5704 - RNA, 22 nt, Human respiratory syncytial virus
cauuauauuucucuauaauuau

SEQ ID NO: 5705 - RNA, 20 nt, Human respiratory syncytial virus
ugcuuguaguauauuugaug

SEQ ID NO: 5706 - RNA, 22 nt, Human respiratory syncytial virus
uuuucucugcuuuauaaaaggg

SEQ ID NO: 5707 - RNA, 16 nt, Human respiratory syncytial virus
ucuuagcccaugagga

SEQ ID NO: 5708 - RNA, 22 nt, Human respiratory syncytial virus
ucugcuagagcaugaguuugac

SEQ ID NO: 5709 - RNA, 22 nt, Human respiratory syncytial virus
uuugcuuauaucuauugauuga

SEQ ID NO: 5710 - RNA, 22 nt, Human respiratory syncytial virus
agcaaauucaaucaagcauuuc

SEQ ID NO: 5711 - RNA, 20 nt, Human respiratory syncytial virus
uguauuuguagugaugugcu

SEQ ID NO: 5712 - RNA, 22 nt, Human respiratory syncytial virus
uaaauaucaugauaacuacuau

SEQ ID NO: 5713 - RNA, 22 nt, Human respiratory syncytial virus
uaguaauauuguuaucauuaau

SEQ ID NO: 5714 - RNA, 22 nt, Human respiratory syncytial virus
aacucacgauagaaacguaguc

SEQ ID NO: 5715 - RNA, 21 nt, Human respiratory syncytial virus
ucaaaucucuuucuguaaguu

SEQ ID NO: 5716 - RNA, 22 nt, Human respiratory syncytial virus
uuugaagcuaugacauccuuuu

SEQ ID NO: 5717 - RNA, 21 nt, Human respiratory syncytial virus
acuugcaucuuggcuaagaau

SEQ ID NO: 5718 - RNA, 22 nt, Human respiratory syncytial virus
ugcuuagugugacuggugugcu

SEQ ID NO: 5719 - RNA, 21 nt, Human respiratory syncytial virus
uauaagagcaguccaacagca

SEQ ID NO: 5720 - RNA, 22 nt, Human respiratory syncytial virus
uggcuuuuugugauaauauguu

SEQ ID NO: 5721 - RNA, 22 nt, Human respiratory syncytial virus
uuggguggagaugaagguugug

SEQ ID NO: 5722 - RNA, 22 nt, Human respiratory syncytial virus
uggucuugacuguuguggauug

SEQ ID NO: 5723 - RNA, 22 nt, Human respiratory syncytial virus
cuccugguguuguugaagcuag

SEQ ID NO: 5724 - RNA, 22 nt, Human respiratory syncytial virus
cauauuuuguguuguauucagu

SEQ ID NO: 5725 - RNA, 20 nt, Human respiratory syncytial virus
uuagugcuuccuacuuugug

SEQ ID NO: 5726 - RNA, 22 nt, Human respiratory syncytial virus
uuaguacuuaaaauguaaguau

SEQ ID NO: 5727 - RNA, 21 nt, Human respiratory syncytial virus
ucagauauuuuaugugccaau

SEQ ID NO: 5728 - RNA, 22 nt, Human respiratory syncytial virus
cauagaguaaaaggaugucaua

SEQ ID NO: 5729 - RNA, 22 nt, Human respiratory syncytial virus
ugguuucuuaaacgucuuaaug

SEQ ID NO: 5730 - RNA, 22 nt, Human respiratory syncytial virus
ucuaugucuaagguauuuuuag

SEQ ID NO: 5731 - RNA, 18 nt, Human respiratory syncytial virus
auacauucuuagccaaga

SEQ ID NO: 5732 - RNA, 22 nt, Human respiratory syncytial virus
ucuaauauuuuuuguaguucua

SEQ ID NO: 5733 - RNA, 13 nt, Human respiratory syncytial virus
cuuucaggaaaga

SEQ ID NO: 5734 - RNA, 22 nt, Human respiratory syncytial virus
uccagcuauagaauaugauagu

SEQ ID NO: 5735 - RNA, 22 nt, Human respiratory syncytial virus
uaacaacacucuuuaguuuuga

SEQ ID NO: 5736 - RNA, 22 nt, Human respiratory syncytial virus
ugaccucgaauuucaaauuugc

SEQ ID NO: 5737 - RNA, 22 nt, Human respiratory syncytial virus
gacauauuugccccaguuuuca

SEQ ID NO: 5738 - RNA, 22 nt, Human respiratory syncytial virus
ugucuaauuugaaaucaauauc

SEQ ID NO: 5739 - RNA, 20 nt, Human respiratory syncytial virus
uauuuuacuauuaacauaca

SEQ ID NO: 5740 - RNA, 22 nt, Human respiratory syncytial virus
acaggugauguugauauucaca

SEQ ID NO: 5741 - RNA, 21 nt, Human respiratory syncytial virus
ugauacaaaaacagcauaugu

SEQ ID NO: 5742 - RNA, 22 nt, Human respiratory syncytial virus
aaaugauaacuuuaggauuagu

SEQ ID NO: 5743 - RNA, 22 nt, Human respiratory syncytial virus
aguuauuuaaaaaauuauauga

SEQ ID NO: 5744 - RNA, 22 nt, Human respiratory syncytial virus
aagugcucuacuauccacaaac

SEQ ID NO: 5745 - RNA, 20 nt, Human respiratory syncytial virus
ucaaauggaguuagugucuu

SEQ ID NO: 5746 - RNA, 22 nt, Human respiratory syncytial virus
acauaugcuguuuuuguaucac

SEQ ID NO: 5747 - RNA, 20 nt, Human respiratory syncytial virus
ugaauaucaacaucaccugu

SEQ ID NO: 5748 - RNA, 22 nt, Human respiratory syncytial virus
uguugauuugaauuucaguugu

SEQ ID NO: 5749 - RNA, 15 nt, Human respiratory syncytial virus
cacuucaaauuucau

SEQ ID NO: 5750 - RNA, 22 nt, Human respiratory syncytial virus
uguuuucaaauucacauaaagc

SEQ ID NO: 5751 - RNA, 22 nt, Human respiratory syncytial virus
uguguaggguugagugucuuca

SEQ ID NO: 5752 - RNA, 22 nt, Human respiratory syncytial virus
gauuuuugucugcuuuaagaug

SEQ ID NO: 5753 - RNA, 22 nt, Human respiratory syncytial virus
ucuuuaacagcugaaaguauau

SEQ ID NO: 5754 - RNA, 22 nt, Human respiratory syncytial virus
uagaccaugugaauucccugca

SEQ ID NO: 5755 - RNA, 15 nt, Human respiratory syncytial virus
acaacaaauuaucac

SEQ ID NO: 5756 - RNA, 22 nt, Human respiratory syncytial virus
caauuauaguuauuaaaaauua

SEQ ID NO: 5757 - RNA, 22 nt, Human respiratory syncytial virus
auuuuuuaaauaacuuuuagug

SEQ ID NO: 5758 - RNA, 22 nt, Human respiratory syncytial virus
cacuaaaaguuauuuaaaaaau

SEQ ID NO: 5759 - RNA, 20 nt, Human respiratory syncytial virus
auuuuuaauaacuauaauug

SEQ ID NO: 5760 - RNA, 22 nt, Human respiratory syncytial virus
uugcuguuauauuaucguuugu

SEQ ID NO: 5761 - RNA, 20 nt, Human respiratory syncytial virus
uucuucguaugaauagcugg

SEQ ID NO: 5762 - RNA, 22 nt, Human respiratory syncytial virus
uuuuuucuugggaucuuugggu

SEQ ID NO: 5763 - RNA, 22 nt, Human respiratory syncytial virus
cuuuauugauucuaggaauuua

SEQ ID NO: 5764 - RNA, 22 nt, Human respiratory syncytial virus
uauuguauagguaaaaauguug

SEQ ID NO: 5765 - RNA, 21 nt, Human respiratory syncytial virus
accauuguuaucuaauaagaa

SEQ ID NO: 5766 - RNA, 22 nt, Human respiratory syncytial virus
aaaauaguaaaucuuauaucag

SEQ ID NO: 5767 - RNA, 22 nt, Human respiratory syncytial virus
uaacuaacauacuggaaaaaac

SEQ ID NO: 5768 - RNA, 22 nt, Human respiratory syncytial virus
aaccaaaaauuucaucaugccu

SEQ ID NO: 5769 - RNA, 17 nt, Human respiratory syncytial virus
augcaaauauuaaaagu

SEQ ID NO: 5770 - RNA, 22 nt, Human respiratory syncytial virus
uacauaaugcaugauuuuuuaa

SEQ ID NO: 5771 - RNA, 21 nt, Human respiratory syncytial virus
uauauaaccauacauuucuaa

SEQ ID NO: 5772 - RNA, 22 nt, Human respiratory syncytial virus
uuuacauguuucagcuuguggg

SEQ ID NO: 5773 - RNA, 22 nt, Human respiratory syncytial virus
cugcauugucacaguaccaucc

SEQ ID NO: 5774 - RNA, 22 nt, Human respiratory syncytial virus
caucgaaggguggugucaaaaa

SEQ ID NO: 5775 - RNA, 20 nt, Human respiratory syncytial virus
agcuauaucacuauuggauc

SEQ ID NO: 5776 - RNA, 22 nt, Human respiratory syncytial virus
caauaaucucuuugcuaaucau

SEQ ID NO: 5777 - RNA, 21 nt, Human respiratory syncytial virus
auugcaauacuaaacaaacuu

SEQ ID NO: 5778 - RNA, 22 nt, Human respiratory syncytial virus
cuauguguugacucgagcucuu

SEQ ID NO: 5779 - RNA, 22 nt, Human respiratory syncytial virus
gguuuuguuauggaauacguua

SEQ ID NO: 5780 - RNA, 22 nt, Human respiratory syncytial virus
ggcuccaucuggacuauggagu

SEQ ID NO: 5781 - RNA, 22 nt, Human respiratory syncytial virus
ugcauagaguuguuguuuuaga

SEQ ID NO: 5782 - RNA, 22 nt, Human respiratory syncytial virus
gagggacugauuccaagcugag

SEQ ID NO: 5783 - RNA, 22 nt, Human respiratory syncytial virus
ugagguauguugggguuguguu

SEQ ID NO: 5784 - RNA, 22 nt, Human respiratory syncytial virus
gaaaagaaaugaaauuugaagu

SEQ ID NO: 5785 - RNA, 21 nt, Human respiratory syncytial virus
acaacugaaauucaaaucaac

SEQ ID NO: 5786 - RNA, 22 nt, Human respiratory syncytial virus
ggaauuuaguguuaaugcaggu

SEQ ID NO: 5787 - RNA, 21 nt, Human respiratory syncytial virus
uguaagcacuuacauguuaac

SEQ ID NO: 5788 - RNA, 22 nt, Human respiratory syncytial virus
uauuaauuauaauuuauggauu

SEQ ID NO: 5789 - RNA, 22 nt, Human respiratory syncytial virus
uccaaguaauucagauaauuga

SEQ ID NO: 5790 - RNA, 22 nt, Human respiratory syncytial virus
ugcucuacuauccacaaacaag

SEQ ID NO: 5791 - RNA, 20 nt, Human respiratory syncytial virus
uaucaaauggaguuaguguc

SEQ ID NO: 5792 - RNA, 22 nt, Human respiratory syncytial virus
uacuacaaggauauuugucagg

SEQ ID NO: 5793 - RNA, 22 nt, Human respiratory syncytial virus
uggcauggucauuuguaucacu

SEQ ID NO: 5794 - RNA, 22 nt, Human respiratory syncytial virus
uaguuggagugcuagagaguua

SEQ ID NO: 5795 - RNA, 22 nt, Human respiratory syncytial virus
uaacuaaacaaucagcaugugu

SEQ ID NO: 5796 - RNA, 22 nt, Human respiratory syncytial virus
ugagagguccaauggauuucau

SEQ ID NO: 5797 - RNA, 21 nt, Human respiratory syncytial virus
ugaguacauaugguuauuugg

SEQ ID NO: 5798 - RNA, 22 nt, Human respiratory syncytial virus
ugcuagagcaugaguuugaccu

SEQ ID NO: 5799 - RNA, 17 nt, Human respiratory syncytial virus
uuugcuuauaucuauug

SEQ ID NO: 5800 - RNA, 22 nt, Human respiratory syncytial virus
uguacucucccauuaugccuag

SEQ ID NO: 5801 - RNA, 21 nt, Human respiratory syncytial virus
uaauacuacacuggagaagug

SEQ ID NO: 5802 - RNA, 22 nt, Human respiratory syncytial virus
uguugaauuguuuuacucauaa

SEQ ID NO: 5803 - RNA, 22 nt, Human respiratory syncytial virus
uauauaagucucaguuccuuuu

SEQ ID NO: 5804 - RNA, 22 nt, Human respiratory syncytial virus
uucaaagugaaaaucauuauug

SEQ ID NO: 5805 - RNA, 22 nt, Human respiratory syncytial virus
ugguuuguuuuggcguuguuuu

SEQ ID NO: 5806 - RNA, 22 nt, Human respiratory syncytial virus
uuuucugaucauuuguuauagg

SEQ ID NO: 5807 - RNA, 19 nt, Human respiratory syncytial virus
ugacaauaauucacuauua

SEQ ID NO: 5808 - RNA, 22 nt, Influenza A virus
agugaaaaugaauccaaaucaa

SEQ ID NO: 5809 - RNA, 19 nt, Influenza A virus
uggcucuguuucucucacu

SEQ ID NO: 5810 - RNA, 22 nt, Influenza A virus
gccaguugcaugggccucauau

SEQ ID NO: 5811 - RNA, 22 nt, Influenza A virus
gggcuguaaccaccgaaguggc

SEQ ID NO: 5812 - RNA, 22 nt, Influenza A virus
ucaugcgauccugacaaguguu

SEQ ID NO: 5813 - RNA, 22 nt, Influenza A virus
cacuaaacaacaggcauucaaa

SEQ ID NO: 5814 - RNA, 22 nt, Influenza A virus
uacuccaaaacagaaacggaaa

SEQ ID NO: 5815 - RNA, 22 nt, Influenza A virus
gucaaaaguuugaagagauaag

SEQ ID NO: 5816 - RNA, 22 nt, Influenza A virus
gccaggcaaauggugcaggcaa

SEQ ID NO: 5817 - RNA, 22 nt, Influenza A virus
auccuagcuccaguacuggucu

SEQ ID NO: 5818 - RNA, 22 nt, Influenza A virus
caguacuggagcuaggaugagu

SEQ ID NO: 5819 - RNA, 22 nt, Influenza A virus
ucauugccugcaccauuugccu

SEQ ID NO: 5820 - RNA, 22 nt, Influenza A virus
uuagguuuggaccagccuucaa

SEQ ID NO: 5821 - RNA, 22 nt, Influenza A virus
aagguuucauaaccugagcgug

SEQ ID NO: 5822 - RNA, 22 nt, Influenza A virus
aagcuagcaguugcauuuucau

SEQ ID NO: 5823 - RNA, 20 nt, Influenza A virus
acaaacaugcagccaugcuu

SEQ ID NO: 5824 - RNA, 22 nt, Influenza A virus
uugaaugccuguuguuuagugu

SEQ ID NO: 5825 - RNA, 22 nt, Influenza A virus
uaacacuugucaggaucgcaug

SEQ ID NO: 5826 - RNA, 22 nt, Influenza A virus
gcccagccuuucacuccaugac

SEQ ID NO: 5827 - RNA, 18 nt, Influenza A virus
uaggauccaggcaauggc

SEQ ID NO: 5828 - RNA, 22 nt, Influenza A virus
aaacaaugcuauaauccuuuac

SEQ ID NO: 5829 - RNA, 19 nt, Influenza A virus
ugggccuauuggagccuuu

SEQ ID NO: 5830 - RNA, 22 nt, Influenza A virus
cgccauuuuccguuucuguuuu

SEQ ID NO: 5831 - RNA, 21 nt, Influenza A virus
ucauuacugcuucuccaagcg

SEQ ID NO: 5832 - RNA, 22 nt, Influenza A virus
agcccuuaguaauacuaugguc

SEQ ID NO: 5833 - RNA, 22 nt, Influenza A virus
ccaaagaucacacugaaauucg

SEQ ID NO: 5834 - RNA, 22 nt, Influenza A virus
caggcaaauggugcaggcaaug

SEQ ID NO: 5835 - RNA, 20 nt, Influenza A virus
ucauccuagcuccaguacug

SEQ ID NO: 5836 - RNA, 22 nt, Influenza A virus
ccaggagucggaaugcguuugu

SEQ ID NO: 5837 - RNA, 21 nt, Influenza A virus
uacaguaguaaugacugaugg

SEQ ID NO: 5838 - RNA, 22 nt, Influenza A virus
uagugagagaaacagagccaau

SEQ ID NO: 5839 - RNA, 22 nt, Influenza A virus
auuuggauucauuuucacuccu

SEQ ID NO: 5840 - RNA, 22 nt, Influenza A virus
caggagucggaaugcguuugua

SEQ ID NO: 5841 - RNA, 20 nt, Influenza A virus
uacaguaguaaugacugaug

SEQ ID NO: 5842 - RNA, 22 nt, Influenza A virus
agaucccaaugauacucgcagc

SEQ ID NO: 5843 - RNA, 21 nt, Influenza A virus
gucacuugaaucguugcaucu

SEQ ID NO: 5844 - RNA, 22 nt, Influenza A virus
aucguagauauaaauguaaagg

SEQ ID NO: 5845 - RNA, 20 nt, Influenza A virus
uuccaguuaugugugcucag

SEQ ID NO: 5846 - RNA, 22 nt, Influenza A virus
cacuccucgacaugcugagcac

SEQ ID NO: 5847 - RNA, 21 nt, Influenza A virus
cuaguaugaacgauuuucccc

SEQ ID NO: 5848 - RNA, 22 nt, Influenza A virus
ugccaugacaguugacuuuuca

SEQ ID NO: 5849 - RNA, 22 nt, Influenza A virus
gagguuucuuuguacagaaaac

SEQ ID NO: 5850 - RNA, 22 nt, Influenza A virus
uccugacaaguguuaucaauuu

SEQ ID NO: 5851 - RNA, 18 nt, Influenza A virus
cacuaaacaacaggcauu

SEQ ID NO: 5852 - RNA, 22 nt, Influenza A virus
cgauucauuagcugugagacca

SEQ ID NO: 5853 - RNA, 21 nt, Influenza A virus
ugguguuggcuaaugcaguug

SEQ ID NO: 5854 - RNA, 22 nt, Influenza A virus
cacagcacacaaauuggcggga

SEQ ID NO: 5855 - RNA, 22 nt, Influenza A virus
cgacugaagaacaagcugugga

SEQ ID NO: 5856 - RNA, 22 nt, Influenza A virus
uccaccauccuugucccgccaa

SEQ ID NO: 5857 - RNA, 22 nt, Influenza A virus
ucuccaauaaagaugcuagugg

SEQ ID NO: 5858 - RNA, 22 nt, Influenza A virus
ucucgaacauguauccuuuucc

SEQ ID NO: 5859 - RNA, 15 nt, Influenza A virus
ccauuuuguuugaga

SEQ ID NO: 5860 - RNA, 22 nt, Influenza A virus
aagucguucaacaaacaagggu

SEQ ID NO: 5861 - RNA, 22 nt, Influenza A virus
agacuuaugauuggacauuaaa

SEQ ID NO: 5862 - RNA, 22 nt, Influenza A virus
gcauuagccaacaccauagaag

SEQ ID NO: 5863 - RNA, 21 nt, Influenza A virus
uggucucacagcuaaugaauc

SEQ ID NO: 5864 - RNA, 22 nt, Influenza A virus
ugaaccacucagguugauuuuu

SEQ ID NO: 5865 - RNA, 22 nt, Influenza A virus
ccaagaacauucgaggguuuug

SEQ ID NO: 5866 - RNA, 22 nt, Influenza A virus
cacagcacacaaauuggcggga

SEQ ID NO: 5867 - RNA, 21 nt, Influenza A virus
cgacugaagaacaagcugugg

SEQ ID NO: 5868 - RNA, 22 nt, Influenza A virus
gauguugaccaaagccuaauua

SEQ ID NO: 5869 - RNA, 20 nt, Influenza A virus
guaagaagagccgcaguauc

SEQ ID NO: 5870 - RNA, 22 nt, Influenza A virus
agacacagagcuuucuuucaca

SEQ ID NO: 5871 - RNA, 22 nt, Influenza A virus
uggaaugaaaaucaaaacccuc

SEQ ID NO: 5872 - RNA, 22 nt, Influenza A virus
cauuagccaacaccauagaagu

SEQ ID NO: 5873 - RNA, 17 nt, Influenza A virus
uggucucacagcuaaug

SEQ ID NO: 5874 - RNA, 22 nt, Influenza A virus
gcuuguucuucagucggguucu

SEQ ID NO: 5875 - RNA, 22 nt, Influenza A virus
ugucccgccaauuugugugcug

SEQ ID NO: 5876 - RNA, 22 nt, Influenza A virus
cccuuguuuguugaacgacuuc

SEQ ID NO: 5877 - RNA, 22 nt, Influenza A virus
augaguucucaaagaucccugg

SEQ ID NO: 5878 - RNA, 22 nt, Influenza A virus
uggcuaaugcaguugcugccgg

SEQ ID NO: 5879 - RNA, 22 nt, Influenza A virus
uggcgaccuugaguuaguuugu

SEQ ID NO: 5880 - RNA, 22 nt, Influenza A virus
ugcaccuaauguugccuuuuug

SEQ ID NO: 5881 - RNA, 22 nt, Influenza A virus
agcaaaacaacacaaagcaaaa

SEQ ID NO: 5882 - RNA, 22 nt, Influenza A virus
ugcuuuguguuguuuugcuggg

SEQ ID NO: 5883 - RNA, 22 nt, Influenza A virus
cugccaaaaaggcaacauuagg

SEQ ID NO: 5884 - RNA, 22 nt, Influenza A virus
gaaugacgauguugaccaaagc

SEQ ID NO: 5885 - RNA, 22 nt, Influenza A virus
ccgcaguaucagcagauccacu

SEQ ID NO: 5886 - RNA, 22 nt, Influenza A virus
aagcaugauauggcaaaggaaa

SEQ ID NO: 5887 - RNA, 15 nt, Influenza A virus
uuuguauccugacuu

SEQ ID NO: 5888 - RNA, 22 nt, Influenza A virus
acauaguaagaagagccgcagu

SEQ ID NO: 5889 - RNA, 21 nt, Influenza A virus
uagcaucuuuauuggagaugu

SEQ ID NO: 5890 - RNA, 22 nt, Influenza A virus
ugaagucaggauacaaagauug

SEQ ID NO: 5891 - RNA, 22 nt, Influenza A virus
uccuuugccauaucaugcuuuu

SEQ ID NO: 5892 - RNA, 22 nt, Influenza A virus
uugcaccuaauguugccuuuuu

SEQ ID NO: 5893 - RNA, 19 nt, Influenza A virus
ccacaugaugaaccccagc

SEQ ID NO: 5894 - RNA, 22 nt, Influenza A virus
ugcuuuguguuguuuugcuggg

SEQ ID NO: 5895 - RNA, 22 nt, Influenza A virus
cugccaaaaaggcaacauuagg

SEQ ID NO: 5896 - RNA, 22 nt, Influenza A virus
cacuaaguggaaugaaaaucaa

SEQ ID NO: 5897 - RNA, 22 nt, Influenza A virus
auuacauauaucacaaaaaauc

SEQ ID NO: 5898 - RNA, 22 nt, Influenza A virus
uguccaaucauaagucuggcga

SEQ ID NO: 5899 - RNA, 22 nt, Influenza A virus
guccacccuuguuuguugaacg

SEQ ID NO: 5900 - RNA, 22 nt, Influenza A virus
ugaagucaggauacaaagauug

SEQ ID NO: 5901 - RNA, 22 nt, Influenza A virus
uccuuugccauaucaugcuuuu

SEQ ID NO: 5902 - RNA, 22 nt, Influenza A virus
ccgguuccagaucaaagguguu

SEQ ID NO: 5903 - RNA, 21 nt, Influenza A virus
uacaaagauuggauccuaugg

SEQ ID NO: 5904 - RNA, 22 nt, Influenza A virus
gguguugagcugaagucaggau

SEQ ID NO: 5905 - RNA, 22 nt, Influenza A virus
uccuauggauuuccuuugccau

SEQ ID NO: 5906 - RNA, 22 nt, Influenza A virus
ucgcaccaauaauguucucaaa

SEQ ID NO: 5907 - RNA, 21 nt, Influenza A virus
aggaaaaggauacauguucga

SEQ ID NO: 5908 - RNA, 22 nt, Influenza A virus
gcccacaugaugaaccccagca

SEQ ID NO: 5909 - RNA, 16 nt, Influenza A virus
aaaagcaugauauggc

SEQ ID NO: 5910 - RNA, 22 nt, Influenza A virus
gccuaagaauguccaccauccu

SEQ ID NO: 5911 - RNA, 12 nt, Influenza A virus
gugugcuguggc

SEQ ID NO: 5912 - RNA, 22 nt, Influenza A virus
caguugcugccgguugauuucu

SEQ ID NO: 5913 - RNA, 20 nt, Influenza A virus
ucauaagucuggcgaccuug

SEQ ID NO: 5914 - RNA, 22 nt, Influenza A virus
ugcuuuguguuguuuugcuggg

SEQ ID NO: 5915 - RNA, 22 nt, Influenza A virus
cugccaaaaaggcaacauuagg

SEQ ID NO: 5916 - RNA, 22 nt, Influenza A virus
ccacucagguugauuuuuugug

SEQ ID NO: 5917 - RNA, 20 nt, Influenza A virus
ucgccaagaacauucgaggg

SEQ ID NO: 5918 - RNA, 22 nt, Influenza A virus
ugaggaaugacgauguugacca

SEQ ID NO: 5919 - RNA, 19 nt, Influenza A virus
cauaguaagaagagccgca

SEQ ID NO: 5920 - RNA, 22 nt, Influenza A virus
gcaacugcauuagccaacacca

SEQ ID NO: 5921 - RNA, 17 nt, Influenza A virus
uaaugaaucgggaaggc

SEQ ID NO: 5922 - RNA, 22 nt, Influenza A virus
gccuaauuauugcagccaggaa

SEQ ID NO: 5923 - RNA, 13 nt, Influenza A virus
ccgcaguaucagc

SEQ ID NO: 5924 - RNA, 22 nt, Influenza A virus
uuuguguuguuuugcugggguu

SEQ ID NO: 5925 - RNA, 22 nt, Influenza A virus
ccugccaaaaaggcaacauuag

SEQ ID NO: 5926 - RNA, 22 nt, Influenza A virus
gguuccagaucaaagguguuga

SEQ ID NO: 5927 - RNA, 16 nt, Influenza A virus
uacaaagauuggaucc

SEQ ID NO: 5928 - RNA, 22 nt, Influenza A virus
acuggaaacaaugcuauaaucc

SEQ ID NO: 5929 - RNA, 22 nt, Influenza A virus
ccuauuggagccuuuccaguug

SEQ ID NO: 5930 - RNA, 22 nt, Influenza A virus
aguauucauccacacccauuuu

SEQ ID NO: 5931 - RNA, 22 nt, Influenza A virus
agucauaucugguaauacucca

SEQ ID NO: 5932 - RNA, 22 nt, Influenza A virus
ugaaggaugagcugauucucaa

SEQ ID NO: 5933 - RNA, 22 nt, Influenza A virus
uauccacagcuuguucuucagu

SEQ ID NO: 5934 - RNA, 22 nt, Influenza A virus
uaauucagguucgucacuauca

SEQ ID NO: 5935 - RNA, 14 nt, Influenza A virus
ugucucugcaguug

SEQ ID NO: 5936 - RNA, 22 nt, Influenza A virus
ugaaccacucagguugauuuuu

SEQ ID NO: 5937 - RNA, 22 nt, Influenza A virus
ccaaaaacauucgaggguuuug

SEQ ID NO: 5938 - RNA, 22 nt, Influenza A virus
caauuggagagccaucugggcu

SEQ ID NO: 5939 - RNA, 22 nt, Influenza A virus
cccaaggucauuguuuaucaug

SEQ ID NO: 5940 - RNA, 22 nt, Influenza A virus
ugucuuuagccauuccaugaga

SEQ ID NO: 5941 - RNA, 17 nt, Influenza A virus
uuuucccagcaaagaca

SEQ ID NO: 5942 - RNA, 22 nt, Influenza A virus
acccaccaaagcugaaggauga

SEQ ID NO: 5943 - RNA, 22 nt, Influenza A virus
gcuuguucuucagucggguucu

SEQ ID NO: 5944 - RNA, 22 nt, Influenza A virus
aacuuugguuuuucugcuccag

SEQ ID NO: 5945 - RNA, 22 nt, Influenza A virus
cuacuguccaggccauuguucu

SEQ ID NO: 5946 - RNA, 22 nt, Influenza A virus
aguugcaacggcaucauauucc

SEQ ID NO: 5947 - RNA, 20 nt, Influenza A virus
gaccgugggcuggcaucacu

SEQ ID NO: 5948 - RNA, 22 nt, Influenza A virus
gaguguuuugcuuaacauaucu

SEQ ID NO: 5949 - RNA, 20 nt, Influenza A virus
augugauccuguuuacauuu

SEQ ID NO: 5950 - RNA, 22 nt, Influenza A virus
gcuucaucagagggacaaaagu

SEQ ID NO: 5951 - RNA, 20 nt, Influenza A virus
aaacugucaacuagaggagu

SEQ ID NO: 5952 - RNA, 22 nt, Influenza A virus
ucaaagucuacuuucucuggug

SEQ ID NO: 5953 - RNA, 21 nt, Influenza A virus
caagagcccacuuuaguugac

SEQ ID NO: 5954 - RNA, 22 nt, Influenza A virus
uucaaauuaccugcugucaugg

SEQ ID NO: 5955 - RNA, 21 nt, Influenza A virus
ucagaauugcaggacauugaa

SEQ ID NO: 5956 - RNA, 22 nt, Influenza A virus
ugguccauucugaugcaaagag

SEQ ID NO: 5957 - RNA, 22 nt, Influenza A virus
ugcuugggcauuagcaugaacc

SEQ ID NO: 5958 - RNA, 22 nt, Influenza A virus
ugguuugacuauauaagguucu

SEQ ID NO: 5959 - RNA, 22 nt, Influenza A virus
aauguuuuuaugcacuugaucg

SEQ ID NO: 5960 - RNA, 22 nt, Influenza A virus
ucuuguuguucaggcucuuagg

SEQ ID NO: 5961 - RNA, 20 nt, Influenza A virus
ugggaccuuugaucucgggg

SEQ ID NO: 5962 - RNA, 22 nt, Influenza A virus
aaugcuucaucucuguauacau

SEQ ID NO: 5963 - RNA, 10 nt, Influenza A virus
ugcaggcauu

SEQ ID NO: 5964 - RNA, 22 nt, Influenza A virus
uuguuuucccgaucaaccuauu

SEQ ID NO: 5965 - RNA, 22 nt, Influenza A virus
uugguugauugcugcuugagug

SEQ ID NO: 5966 - RNA, 22 nt, Influenza A virus
ggcgauccccaucaguuuccau

SEQ ID NO: 5967 - RNA, 17 nt, Influenza A virus
uggugccuugggacgcc

SEQ ID NO: 5968 - RNA, 22 nt, Influenza A virus
ccaucguagauauaaacauaaa

SEQ ID NO: 5969 - RNA, 22 nt, Influenza A virus
uccaguuaugugugcucagggc

SEQ ID NO: 5970 - RNA, 22 nt, Influenza A virus
ccagaucauuaugugaguuaga

SEQ ID NO: 5971 - RNA, 18 nt, Influenza A virus
ucaccauuguuggcuugg

SEQ ID NO: 5972 - RNA, 22 nt, Influenza A virus
cccaggagucagaaugcguuug

SEQ ID NO: 5973 - RNA, 20 nt, Influenza A virus
caguaguaaugacugauggg

SEQ ID NO: 5974 - RNA, 22 nt, Influenza A virus
uggcuaaugcaguugcugccgg

SEQ ID NO: 5975 - RNA, 22 nt, Influenza A virus
uggcggccuuggguuaguuugu

SEQ ID NO: 5976 - RNA, 22 nt, Influenza A virus
ucaaggccuauguucuuguaug

SEQ ID NO: 5977 - RNA, 22 nt, Influenza A virus
aaacggaacaucaaaggucaaa

SEQ ID NO: 5978 - RNA, 22 nt, Influenza A virus
uggauauaugcaaggcugcaau

SEQ ID NO: 5979 - RNA, 22 nt, Influenza A virus
cuucagcuuugguggguuuaca

SEQ ID NO: 5980 - RNA, 22 nt, Influenza A virus
gaagauugguucagcucauagu

SEQ ID NO: 5981 - RNA, 21 nt, Influenza A virus
aauagccgaagcaauaaucgu

SEQ ID NO: 5982 - RNA, 22 nt, Influenza A virus
aaacaaugcuauaauccuuuau

SEQ ID NO: 5983 - RNA, 15 nt, Influenza A virus
ccuauuggagccuuu

SEQ ID NO: 5984 - RNA, 22 nt, Influenza A virus
uugucccgauuccuuugacugc

SEQ ID NO: 5985 - RNA, 22 nt, Influenza A virus
gcuccggaccuucuagggagag

SEQ ID NO: 5986 - RNA, 22 nt, Influenza A virus
uucaaacacggccuuaaaagag

SEQ ID NO: 5987 - RNA, 22 nt, Influenza A virus
uaccugagucuaugagggaaga

SEQ ID NO: 5988 - RNA, 22 nt, Influenza A virus
agggcaggacuauugguaucag

SEQ ID NO: 5989 - RNA, 20 nt, Influenza A virus
uuauacaauauccggaaccu

SEQ ID NO: 5990 - RNA, 22 nt, Influenza A virus
caggcaaauggugcaggcaaug

SEQ ID NO: 5991 - RNA, 20 nt, Influenza A virus
ucauccuagcuccaguacug

SEQ ID NO: 5992 - RNA, 22 nt, Influenza A virus
uacuuacugacagccagacagc

SEQ ID NO: 5993 - RNA, 16 nt, Influenza A virus
auggccaucaauuaau

SEQ ID NO: 5994 - RNA, 22 nt, Influenza A virus
ugagagggucaguugcucacaa

SEQ ID NO: 5995 - RNA, 16 nt, Influenza A virus
ugcguauggaccugca

SEQ ID NO: 5996 - RNA, 22 nt, Influenza A virus
ugccggcacuuuaauugaagac

SEQ ID NO: 5997 - RNA, 19 nt, Influenza A virus
uccggaguggaguccgccg

SEQ ID NO: 5998 - RNA, 22 nt, Influenza A virus
ucgccaaaaacauucgaggguu

SEQ ID NO: 5999 - RNA, 16 nt, Influenza A virus
uaguguuguccccagu

SEQ ID NO: 6000 - RNA, 22 nt, Influenza A virus
uuuguguugcuuuguugggguu

SEQ ID NO: 6001 - RNA, 22 nt, Influenza A virus
ccugccaaaaaggcaacauuag

SEQ ID NO: 6002 - RNA, 22 nt, Influenza A virus
uuaauugauggccauccgaauu

SEQ ID NO: 6003 - RNA, 22 nt, Influenza A virus
uggucgcugucuggcugucagu

SEQ ID NO: 6004 - RNA, 22 nt, Influenza A virus
uguacaguuugucaaauuuuuc

SEQ ID NO: 6005 - RNA, 22 nt, Influenza A virus
gcauagucacguucaaugcugg

SEQ ID NO: 6006 - RNA, 22 nt, Influenza A virus
gauaauucucauccauuagcuc

SEQ ID NO: 6007 - RNA, 22 nt, Influenza A virus
gacuucagggaugugaagguuc

SEQ ID NO: 6008 - RNA, 22 nt, Influenza A virus
caucagucauuacuacuguaca

SEQ ID NO: 6009 - RNA, 22 nt, Influenza A virus
gauacaaacgcauucugacucc

SEQ ID NO: 6010 - RNA, 22 nt, Influenza A virus
caucucugugcuuggagucaua

SEQ ID NO: 6011 - RNA, 19 nt, Influenza A virus
aaccauucccaucacacug

SEQ ID NO: 6012 - RNA, 22 nt, Influenza A virus
agaucccaaugauacucgcggc

SEQ ID NO: 6013 - RNA, 21 nt, Influenza A virus
gucacuugaaucguugcaucu

SEQ ID NO: 6014 - RNA, 22 nt, Influenza A virus
uauaugcaaggcugcaauggga

SEQ ID NO: 6015 - RNA, 21 nt, Influenza A virus
ucauccuucagcuuugguggg

SEQ ID NO: 6016 - RNA, 22 nt, Influenza A virus
aaccgggagacauacuuuugau

SEQ ID NO: 6017 - RNA, 19 nt, Influenza A virus
ucuaauugcuccucggggu

SEQ ID NO: 6018 - RNA, 22 nt, Influenza A virus
uagacgguugguacgguuucag

SEQ ID NO: 6019 - RNA, 18 nt, Influenza A virus
aacaggacaagcagcaga

SEQ ID NO: 6020 - RNA, 22 nt, Influenza A virus
agugagcaggcagcggaggcca

SEQ ID NO: 6021 - RNA, 20 nt, Influenza A virus
aggcaaauggugcaggcaau

SEQ ID NO: 6022 - RNA, 22 nt, Influenza A virus
augacguguggaugggaagaac

SEQ ID NO: 6023 - RNA, 21 nt, Influenza A virus
uacgcucaggauaugaaaccu

SEQ ID NO: 6024 - RNA, 22 nt, Influenza A virus
cugcgagcuaacugauucaauc

SEQ ID NO: 6025 - RNA, 20 nt, Influenza A virus
ugaaauuggagaggacguag

SEQ ID NO: 6026 - RNA, 22 nt, Influenza A virus
ccucuuuugauaugaguaauga

SEQ ID NO: 6027 - RNA, 20 nt, Influenza A virus
ucggagacaaugcagaagag

SEQ ID NO: 6028 - RNA, 22 nt, Influenza A virus
ucuuugugcagcuguuugaaau

SEQ ID NO: 6029 - RNA, 22 nt, Influenza A virus
uaagaauguugcacauucucuc

SEQ ID NO: 6030 - RNA, 22 nt, Influenza A virus
ugagagaaacagagccaaucgu

SEQ ID NO: 6031 - RNA, 22 nt, Influenza A virus
auuuggauucaucuuuacuccu

SEQ ID NO: 6032 - RNA, 22 nt, Influenza A virus
gagacugugauucuuccugaug

SEQ ID NO: 6033 - RNA, 22 nt, Influenza A virus
uauaggcugauuuggucauugu

SEQ ID NO: 6034 - RNA, 22 nt, Influenza A virus
ugucaggaagugcucagcaugu

SEQ ID NO: 6035 - RNA, 19 nt, Influenza A virus
cucgauauccuggugucag

SEQ ID NO: 6036 - RNA, 22 nt, Influenza A virus
ugucugaaguccuucccuccgu

SEQ ID NO: 6037 - RNA, 16 nt, Influenza A virus
ugguugacuuuucaaa

SEQ ID NO: 6038 - RNA, 22 nt, Influenza A virus
uacuuuuggguaauggaccgua

SEQ ID NO: 6039 - RNA, 22 nt, Influenza A virus
uccauuucuauuccaccauguu

SEQ ID NO: 6040 - RNA, 22 nt, Influenza A virus
uaaagaugaauccaaaucaaaa

SEQ ID NO: 6041 - RNA, 22 nt, Influenza A virus
uggcucuguuucucucaccauu

SEQ ID NO: 6042 - RNA, 22 nt, Influenza A virus
ucauccucaagaauuccccuuu

SEQ ID NO: 6043 - RNA, 22 nt, Influenza A virus
uagagcgguuccucuugggauu

SEQ ID NO: 6044 - RNA, 22 nt, Influenza A virus
uauaugggccccccaguuuucu

SEQ ID NO: 6045 - RNA, 20 nt, Influenza A virus
ccgcgcugggguguucuucc

SEQ ID NO: 6046 - RNA, 22 nt, Influenza A virus
uccgcugccugcucacuugauc

SEQ ID NO: 6047 - RNA, 20 nt, Influenza A virus
uagccuuagcuguagugcug

SEQ ID NO: 6048 - RNA, 22 nt, Influenza A virus
ucugcuggagugacugaaggag

SEQ ID NO: 6049 - RNA, 22 nt, Influenza A virus
caucuccauuccccauuucauu

SEQ ID NO: 6050 - RNA, 22 nt, Influenza A virus
uucauugaaauacuucagguca

SEQ ID NO: 6051 - RNA, 20 nt, Influenza A virus
uuucugcggguauuuguguu

SEQ ID NO: 6052 - RNA, 22 nt, Influenza A virus
uucuuuccauccaaagaauguu

SEQ ID NO: 6053 - RNA, 21 nt, Influenza A virus
ucgcaucauauaauggaaucc

SEQ ID NO: 6054 - RNA, 22 nt, Influenza A virus
uuuguguugcuuuguugggguu

SEQ ID NO: 6055 - RNA, 22 nt, Influenza A virus
cugccaaaaaggcaacauuagg

SEQ ID NO: 6056 - RNA, 22 nt, Influenza A virus
uuguuuugcugggguucaucau

SEQ ID NO: 6057 - RNA, 21 nt, Influenza A virus
ugggccugccaaaaaggcaac

SEQ ID NO: 6058 - RNA, 22 nt, Influenza A virus
uguugcaccuaauguugccuuu

SEQ ID NO: 6059 - RNA, 22 nt, Influenza A virus
caggcccacaugaugaacccca

SEQ ID NO: 6060 - RNA, 22 nt, Influenza A virus
gaagucaggauacaaagauugg

SEQ ID NO: 6061 - RNA, 21 nt, Influenza A virus
uccuuugccauaucaugcuuu

SEQ ID NO: 6062 - RNA, 22 nt, Influenza A virus
ugcuuuguguuguuuugcuggg

SEQ ID NO: 6063 - RNA, 22 nt, Influenza A virus
cugccaaaaaggcaacauuagg

SEQ ID NO: 6064 - RNA, 22 nt, Influenza A virus
gcuuuguguuguuuugcugggg

SEQ ID NO: 6065 - RNA, 22 nt, Influenza A virus
cugccaaaaaggcaacauuagg

SEQ ID NO: 6066 - RNA, 22 nt, Influenza A virus
agcaaaaagcaugauauggcaa

SEQ ID NO: 6067 - RNA, 20 nt, Influenza A virus
uuuguauccugacuucagcu

SEQ ID NO: 6068 - RNA, 22 nt, Influenza A virus
ccacaugaugaaccccagcaaa

SEQ ID NO: 6069 - RNA, 15 nt, Influenza A virus
aaaagcaugauaugg

SEQ ID NO: 6070 - RNA, 22 nt, Influenza A virus
gcccacaugaugaaccccagca

SEQ ID NO: 6071 - RNA, 16 nt, Influenza A virus
aaaagcaugauauggc

SEQ ID NO: 6072 - RNA, 22 nt, Influenza A virus
ugcuuuguguuguuuugcuggg

SEQ ID NO: 6073 - RNA, 22 nt, Influenza A virus
cugccaaaaaggcaacauuagg

SEQ ID NO: 6074 - RNA, 22 nt, Influenza A virus
uugagcugaagucaggauacaa

SEQ ID NO: 6075 - RNA, 22 nt, Influenza A virus
ggauccuauggauuuccuuugc

SEQ ID NO: 6076 - RNA, 22 nt, Influenza A virus
ugaagucaggauacaaagauug

SEQ ID NO: 6077 - RNA, 22 nt, Influenza A virus
uccuuugccauaucaugcuuuu

SEQ ID NO: 6078 - RNA, 22 nt, Vaccinia virus
aagauguguauguuugugaaaa

SEQ ID NO: 6079 - RNA, 22 nt, Vaccinia virus
agcacaaaucaaggguauuaau

SEQ ID NO: 6080 - RNA, 22 nt, Vaccinia virus
uguuauaagaauguaguuaauu

SEQ ID NO: 6081 - RNA, 22 nt, Vaccinia virus
uccucuuuccucuuauaacauc

SEQ ID NO: 6082 - RNA, 22 nt, Vaccinia virus
uguuauaagaauguaguuaauu

SEQ ID NO: 6083 - RNA, 22 nt, Vaccinia virus
uccucuuuccucuuauaacauc

SEQ ID NO: 6084 - RNA, 22 nt, Vaccinia virus
acgauauuugugaaaaauauua

SEQ ID NO: 6085 - RNA, 22 nt, Vaccinia virus
uacuuuuuuuauuaaaugacgu

SEQ ID NO: 6086 - RNA, 22 nt, Vaccinia virus
uacacgugucgauucaucaagg

SEQ ID NO: 6087 - RNA, 22 nt, Vaccinia virus
uggggaugaggcuaccucgaca

SEQ ID NO: 6088 - RNA, 22 nt, Vaccinia virus
uaaaaagaagauauagacacac

SEQ ID NO: 6089 - RNA, 22 nt, Vaccinia virus
ucuguauauuucuaaaaguuuu

SEQ ID NO: 6090 - RNA, 22 nt, Vaccinia virus
uagaaacgagcuauuucaacuc

SEQ ID NO: 6091 - RNA, 22 nt, Vaccinia virus
gcacauugaacaaugcuagugu

SEQ ID NO: 6092 - RNA, 22 nt, Vaccinia virus
cguuuguuaaagucugcuaucg

SEQ ID NO: 6093 - RNA, 22 nt, Vaccinia virus
ucaaacaauuuuaacagaugua

SEQ ID NO: 6094 - RNA, 22 nt, Vaccinia virus
uauccggaguuaugacaaacga

SEQ ID NO: 6095 - RNA, 22 nt, Vaccinia virus
uaucgcuagcuucgaaauuagg

SEQ ID NO: 6096 - RNA, 22 nt, Vaccinia virus
cgucuugcacguaaucuauuau

SEQ ID NO: 6097 - RNA, 22 nt, Vaccinia virus
uauaauuauuuuguaagaugau

SEQ ID NO: 6098 - RNA, 22 nt, Vaccinia virus
uucuaaucauauuauuuuugcc

SEQ ID NO: 6099 - RNA, 22 nt, Vaccinia virus
uaauauaugauaaauugauacu

SEQ ID NO: 6100 - RNA, 22 nt, Vaccinia virus
agauuuccuauugucuuacuca

SEQ ID NO: 6101 - RNA, 22 nt, Vaccinia virus
aguaagaugguuuacaaauuag

SEQ ID NO: 6102 - RNA, 22 nt, Vaccinia virus
cuaaaguuggccgucaucuuac

SEQ ID NO: 6103 - RNA, 22 nt, Vaccinia virus
agaauaacgaccugcacuaaua

SEQ ID NO: 6104 - RNA, 22 nt, Vaccinia virus
ccuaauagcuugcggcagauau

SEQ ID NO: 6105 - RNA, 22 nt, Vaccinia virus
uccaaucgcauagcuauaaaau

SEQ ID NO: 6106 - RNA, 22 nt, Vaccinia virus
uaauaggauaagacuaaugcuu

SEQ ID NO: 6107 - RNA, 22 nt, Vaccinia virus
gacauuuuuuguccuauauauc

SEQ ID NO: 6108 - RNA, 22 nt, Vaccinia virus
uuaucuaugguauuaagaauuc

SEQ ID NO: 6109 - RNA, 22 nt, Vaccinia virus
ccaauuccuuuuugccuguauc

SEQ ID NO: 6110 - RNA, 22 nt, Vaccinia virus
ucugaaucgauaacucuauuca

SEQ ID NO: 6111 - RNA, 22 nt, Vaccinia virus
guaggguuaaucgaacgauuca

SEQ ID NO: 6112 - RNA, 22 nt, Vaccinia virus
ucugaaucgauaacucuauuca

SEQ ID NO: 6113 - RNA, 22 nt, Vaccinia virus
guaggguuaaucgaacgauuca

SEQ ID NO: 6114 - RNA, 22 nt, Vaccinia virus
aauggcuguaaucucuaagguu

SEQ ID NO: 6115 - RNA, 22 nt, Vaccinia virus
ucaaaaagagauuaaugcuaca

SEQ ID NO: 6116 - RNA, 22 nt, Vaccinia virus
ucaggagaugaucucgccguag

SEQ ID NO: 6117 - RNA, 22 nt, Vaccinia virus
ucgucgacaucuaucuuugcau

SEQ ID NO: 6118 - RNA, 22 nt, Vaccinia virus
aauaauuuuugaugcuguugaa

SEQ ID NO: 6119 - RNA, 22 nt, Vaccinia virus
uaucuauuauccagaggaguua

SEQ ID NO: 6120 - RNA, 22 nt, Vaccinia virus
uguucauuggaguugauaauaa

SEQ ID NO: 6121 - RNA, 20 nt, Vaccinia virus
auuggauucacgguggguca

SEQ ID NO: 6122 - RNA, 22 nt, Vaccinia virus
uauauguaaucauuguccagau

SEQ ID NO: 6123 - RNA, 22 nt, Vaccinia virus
ugcacucaugauucacguuaua

SEQ ID NO: 6124 - RNA, 22 nt, Vaccinia virus
ugccucuuacuagcuuaguuau

SEQ ID NO: 6125 - RNA, 22 nt, Vaccinia virus
uaacucaaauguaucguggagg

SEQ ID NO: 6126 - RNA, 22 nt, Vaccinia virus
cauuagaaugggaauuuuuuau

SEQ ID NO: 6127 - RNA, 22 nt, Vaccinia virus
cgguagauccccaucuaaugaa

SEQ ID NO: 6128 - RNA, 22 nt, Vaccinia virus
accuauauauuuauuuucaguu

SEQ ID NO: 6129 - RNA, 21 nt, Vaccinia virus
uuguaaaaaauauguuagguu

SEQ ID NO: 6130 - RNA, 22 nt, Vaccinia virus
aacuaguggauauuugugaucg

SEQ ID NO: 6131 - RNA, 22 nt, Vaccinia virus
uccguuuacuacaacuagugaa

SEQ ID NO: 6132 - RNA, 22 nt, Vaccinia virus
ugccgcauacaauaacuuguua

SEQ ID NO: 6133 - RNA, 22 nt, Vaccinia virus
caaaguguuuagcguggcuaga

SEQ ID NO: 6134 - RNA, 22 nt, Vaccinia virus
uagaacucuuuucauccaguug

SEQ ID NO: 6135 - RNA, 22 nt, Vaccinia virus
cugauuaaugagaucuucuauu

SEQ ID NO: 6136 - RNA, 22 nt, Vaccinia virus
aguagguaauggccaugggaac

SEQ ID NO: 6137 - RNA, 22 nt, Vaccinia virus
uugcauauuuaucuuucuugcc

SEQ ID NO: 6138 - RNA, 22 nt, Vaccinia virus
ucuuugguaucucuaauauaga

SEQ ID NO: 6139 - RNA, 22 nt, Vaccinia virus
uagaacaaaagauacuagaauc

SEQ ID NO: 6140 - RNA, 22 nt, Vaccinia virus
uguguuuauagagcccacguuu

SEQ ID NO: 6141 - RNA, 21 nt, Vaccinia virus
auuaaguguuuauaaacacag

SEQ ID NO: 6142 - RNA, 22 nt, Vaccinia virus
uggaggauuuaucgcauacuag

SEQ ID NO: 6143 - RNA, 22 nt, Vaccinia virus
uuagaaagauuaaaucauuaaa

SEQ ID NO: 6144 - RNA, 22 nt, Vaccinia virus
ucugaaggacggaugaauucua

SEQ ID NO: 6145 - RNA, 20 nt, Vaccinia virus
gauauucuccguucuuuaga

SEQ ID NO: 6146 - RNA, 22 nt, Vaccinia virus
aaguuauagaauguaucuguca

SEQ ID NO: 6147 - RNA, 20 nt, Vaccinia virus
uagaucauaucuacuaauuu

SEQ ID NO: 6148 - RNA, 22 nt, Vaccinia virus
uacaaauugauauggucgucgu

SEQ ID NO: 6149 - RNA, 22 nt, Vaccinia virus
acagucggugguccaauuuuua

SEQ ID NO: 6150 - RNA, 22 nt, Vaccinia virus
uguucguguguucuugcgguga

SEQ ID NO: 6151 - RNA, 22 nt, Vaccinia virus
uagcagaugcaaaauacgaaua

SEQ ID NO: 6152 - RNA, 22 nt, Vaccinia virus
uauaacuaaacagucuaucauc

SEQ ID NO: 6153 - RNA, 22 nt, Vaccinia virus
ugaaauucuuguuuagacguuu

SEQ ID NO: 6154 - RNA, 22 nt, Vaccinia virus
uuggucgguguuuggucuugcu

SEQ ID NO: 6155 - RNA, 21 nt, Vaccinia virus
uaauaacaucgauucccauau

SEQ ID NO: 6156 - RNA, 22 nt, Vaccinia virus
ugauauauauguaaugggugga

SEQ ID NO: 6157 - RNA, 22 nt, Vaccinia virus
acguaugaaaaauauguaguau

SEQ ID NO: 6158 - RNA, 22 nt, Vaccinia virus
ucaauaacuggcacaacaauaa

SEQ ID NO: 6159 - RNA, 22 nt, Vaccinia virus
uuucgccgccgccauuuaguua

SEQ ID NO: 6160 - RNA, 22 nt, Vaccinia virus
agucgguuauaaauucuauaua

SEQ ID NO: 6161 - RNA, 20 nt, Vaccinia virus
auguguacuuauaaucgacu

SEQ ID NO: 6162 - RNA, 22 nt, Vaccinia virus
ucgauaucucaaucauggacuu

SEQ ID NO: 6163 - RNA, 22 nt, Vaccinia virus
aaaacuguccaaauagauguac

SEQ ID NO: 6164 - RNA, 22 nt, Vaccinia virus
aauuauccaaaaucuaauuccg

SEQ ID NO: 6165 - RNA, 22 nt, Vaccinia virus
gaccuaggguauguugguuaca

SEQ ID NO: 6166 - RNA, 22 nt, Vaccinia virus
uauauugcuguagcgacuguac

SEQ ID NO: 6167 - RNA, 17 nt, Vaccinia virus
gucauacacgcaguaua

SEQ ID NO: 6168 - RNA, 22 nt, Vaccinia virus
uuauuuuuauaaaguuuagucu

SEQ ID NO: 6169 - RNA, 22 nt, Vaccinia virus
cuagauaaacuaucaguaaguu

SEQ ID NO: 6170 - RNA, 22 nt, Vaccinia virus
uaaaauugauguaguggucucc

SEQ ID NO: 6171 - RNA, 18 nt, Vaccinia virus
caaucucauuaauuuuau

SEQ ID NO: 6172 - RNA, 22 nt, Vaccinia virus
uuauuuaaaguuaaauggcugc

SEQ ID NO: 6173 - RNA, 22 nt, Vaccinia virus
ucguucuacaauuuuugacaua

SEQ ID NO: 6174 - RNA, 22 nt, Vaccinia virus
uugaaaucuaguucugcauugu

SEQ ID NO: 6175 - RNA, 22 nt, Vaccinia virus
uguaguguuggauaucuucaac

SEQ ID NO: 6176 - RNA, 22 nt, Vaccinia virus
uagauaugauaacaggaauaac

SEQ ID NO: 6177 - RNA, 17 nt, Vaccinia virus
uugucaucgucaucuau

SEQ ID NO: 6178 - RNA, 22 nt, Vaccinia virus
aguaggcguacaagcagccaaa

SEQ ID NO: 6179 - RNA, 22 nt, Vaccinia virus
uggcaauuagugcgcuauuacu

SEQ ID NO: 6180 - RNA, 22 nt, Vaccinia virus
ccguaccguauauuuggauuaa

SEQ ID NO: 6181 - RNA, 22 nt, Vaccinia virus
auccguaacauauacaacuuuu

SEQ ID NO: 6182 - RNA, 22 nt, Vaccinia virus
gaagaucucauuaaucaguugg

SEQ ID NO: 6183 - RNA, 22 nt, Vaccinia virus
aacuggaugaaaagaguucuau

SEQ ID NO: 6184 - RNA, 22 nt, Vaccinia virus
aauauaaucugccguauuggau

SEQ ID NO: 6185 - RNA, 19 nt, Vaccinia virus
auugcauuuagauuauauu

SEQ ID NO: 6186 - RNA, 22 nt, Vaccinia virus
uaaucuauuauuauuggcucug

SEQ ID NO: 6187 - RNA, 22 nt, Vaccinia virus
cugcaccuaaucuauuaauuac

SEQ ID NO: 6188 - RNA, 22 nt, Vaccinia virus
uaauaucguuuucguauuugua

SEQ ID NO: 6189 - RNA, 22 nt, Vaccinia virus
aaauacuuuauucgauacaaag

SEQ ID NO: 6190 - RNA, 22 nt, Vaccinia virus
uuagucucucaguuugcuuaug

SEQ ID NO: 6191 - RNA, 22 nt, Vaccinia virus
uauauaggacaauuugacauga

SEQ ID NO: 6192 - RNA, 22 nt, Vaccinia virus
uuuauuuguccgauagugacua

SEQ ID NO: 6193 - RNA, 22 nt, Vaccinia virus
uaguuagugagaucguagaaga

SEQ ID NO: 6194 - RNA, 22 nt, Vaccinia virus
uacugguuucauguuucuacua

SEQ ID NO: 6195 - RNA, 22 nt, Vaccinia virus
uauuauuuuuaugaacuuguac

SEQ ID NO: 6196 - RNA, 22 nt, Vaccinia virus
agugaaaaaaauguaaauacuu

SEQ ID NO: 6197 - RNA, 22 nt, Vaccinia virus
auuaguaaaacuuuuuuuuauu

SEQ ID NO: 6198 - RNA, 22 nt, Vaccinia virus
agugaaaaaaauguaaauacuu

SEQ ID NO: 6199 - RNA, 22 nt, Vaccinia virus
auuaguaaaacuuuuuuuuauu

SEQ ID NO: 6200 - RNA, 22 nt, Vaccinia virus
uuaccgcauuuaucuaacacua

SEQ ID NO: 6201 - RNA, 17 nt, Vaccinia virus
aacaccaaugcggugac

SEQ ID NO: 6202 - RNA, 22 nt, Vaccinia virus
gcuccgacgauauuccuccucg

SEQ ID NO: 6203 - RNA, 22 nt, Vaccinia virus
cggaggcggauaagccggaugc

SEQ ID NO: 6204 - RNA, 22 nt, Vaccinia virus
uggagguucgucagcggcucua

SEQ ID NO: 6205 - RNA, 22 nt, Vaccinia virus
gcguaguauuccuacuuuuaca

SEQ ID NO: 6206 - RNA, 22 nt, Vaccinia virus
gacauggaagagugcuaacuau

SEQ ID NO: 6207 - RNA, 22 nt, Vaccinia virus
uaguuuucguuuacacgcuucu

SEQ ID NO: 6208 - RNA, 22 nt, Vaccinia virus
ucacaagcuaagaaaccugaag

SEQ ID NO: 6209 - RNA, 22 nt, Vaccinia virus
ucuuguaaagucuaguuuugug

SEQ ID NO: 6210 - RNA, 22 nt, Vaccinia virus
aauauaaucuaaaugcaauugu

SEQ ID NO: 6211 - RNA, 17 nt, Vaccinia virus
auacggcagauuauauu

SEQ ID NO: 6212 - RNA, 22 nt, Vaccinia virus
uauauuuccagcguuaagugua

SEQ ID NO: 6213 - RNA, 22 nt, Vaccinia virus
cacgugacgugguaucaauuaa

SEQ ID NO: 6214 - RNA, 22 nt, Vaccinia virus
ucauauuuuuaaucuccguuau

SEQ ID NO: 6215 - RNA, 17 nt, Vaccinia virus
ugugacaaaaauaauga

SEQ ID NO: 6216 - RNA, 22 nt, Vaccinia virus
uaaaaaacgauagcuuuuuaua

SEQ ID NO: 6217 - RNA, 22 nt, Vaccinia virus
uauccuggagcgugugacuuuu

SEQ ID NO: 6218 - RNA, 22 nt, Vaccinia virus
uaaaaagauaguuucacuauug

SEQ ID NO: 6219 - RNA, 22 nt, Vaccinia virus
auguggaaauaaaggcgauauc

SEQ ID NO: 6220 - RNA, 22 nt, Vaccinia virus
ugcauaugcugcuacuuacugg

SEQ ID NO: 6221 - RNA, 22 nt, Vaccinia virus
cacuaguaacagucugaacgca

SEQ ID NO: 6222 - RNA, 22 nt, Vaccinia virus
agacuucuggcgguugccauag

SEQ ID NO: 6223 - RNA, 18 nt, Vaccinia virus
auuaccaacuagaagucu

SEQ ID NO: 6224 - RNA, 22 nt, Vaccinia virus
ucuguuacgaaaaucaauauau

SEQ ID NO: 6225 - RNA, 22 nt, Vaccinia virus
aucacuugauucgucacuaaua

SEQ ID NO: 6226 - RNA, 22 nt, Vaccinia virus
ugguaacuucgaaaccguuauu

SEQ ID NO: 6227 - RNA, 22 nt, Vaccinia virus
uauagggauaggaguaggaaug

SEQ ID NO: 6228 - RNA, 22 nt, Vaccinia virus
uucuuuagcgggcuuaaagacu

SEQ ID NO: 6229 - RNA, 22 nt, Vaccinia virus
ugcugaaauaaccacaucugga

SEQ ID NO: 6230 - RNA, 22 nt, Vaccinia virus
gccgaaacucgucauaauuggg

SEQ ID NO: 6231 - RNA, 22 nt, Vaccinia virus
ucaaaauaugucaaagaguuua

SEQ ID NO: 6232 - RNA, 22 nt, Vaccinia virus
caaauaauuggaauaauucaga

SEQ ID NO: 6233 - RNA, 22 nt, Vaccinia virus
uguuucuaguucuaauuauuuc

SEQ ID NO: 6234 - RNA, 22 nt, Vaccinia virus
uaucauuugguucaucuaugua

SEQ ID NO: 6235 - RNA, 19 nt, Vaccinia virus
caugaucuauagaugaugu

SEQ ID NO: 6236 - RNA, 22 nt, Vaccinia virus
uuauuaucuuguuccauauuag

SEQ ID NO: 6237 - RNA, 19 nt, Vaccinia virus
aaggcgucaaagauaauag

SEQ ID NO: 6238 - RNA, 22 nt, Vaccinia virus
gcgaagcgacgucauuuaauaa

SEQ ID NO: 6239 - RNA, 22 nt, Vaccinia virus
uuuucacaaauaucguucgcgg

SEQ ID NO: 6240 - RNA, 22 nt, Vaccinia virus
uccuaaauguguauucuccuuc

SEQ ID NO: 6241 - RNA, 21 nt, Vaccinia virus
gauugaaugccauuuacggau

SEQ ID NO: 6242 - RNA, 22 nt, Vaccinia virus
uuaucgauuuuuaauugcauuu

SEQ ID NO: 6243 - RNA, 22 nt, Vaccinia virus
ccuuuauuucuucuuccauaaa

SEQ ID NO: 6244 - RNA, 22 nt, Vaccinia virus
uauuuuuguuuauaaaacaauu

SEQ ID NO: 6245 - RNA, 20 nt, Vaccinia virus
uauauacucuaacaaaaaua

SEQ ID NO: 6246 - RNA, 22 nt, Vaccinia virus
uccaguauuuugaugauaucca

SEQ ID NO: 6247 - RNA, 22 nt, Vaccinia virus
guuguauuauuggguguauugg

SEQ ID NO: 6248 - RNA, 22 nt, Vaccinia virus
aaguaaagauuucaaagauguu

SEQ ID NO: 6249 - RNA, 22 nt, Vaccinia virus
auaccauccaagucaauaucuu

SEQ ID NO: 6250 - RNA, 22 nt, Vaccinia virus
ugucaauugaguuuauaagaau

SEQ ID NO: 6251 - RNA, 19 nt, Vaccinia virus
uuccaacaagcaauugacg

SEQ ID NO: 6252 - RNA, 22 nt, Vaccinia virus
cguggaugauuaauauuaugau

SEQ ID NO: 6253 - RNA, 22 nt, Vaccinia virus
uccuaauaauauaauaccgacg

SEQ ID NO: 6254 - RNA, 22 nt, Vaccinia virus
ugcuaguuacgaaccagaauca

SEQ ID NO: 6255 - RNA, 20 nt, Vaccinia virus
aaguucggcgcagcuaguac

SEQ ID NO: 6256 - RNA, 22 nt, Vaccinia virus
aauucuuguagaguagaugagu

SEQ ID NO: 6257 - RNA, 15 nt, Vaccinia virus
uauaucauaagaauu

SEQ ID NO: 6258 - RNA, 22 nt, Vaccinia virus
uuguacugaauccgccuaagcg

SEQ ID NO: 6259 - RNA, 22 nt, Vaccinia virus
uauauuggcggaagacgguaac

SEQ ID NO: 6260 - RNA, 22 nt, Vaccinia virus
uauuuuuguaaaacuuuuuuua

SEQ ID NO: 6261 - RNA, 18 nt, Vaccinia virus
agaaagagaauaaaaaua

SEQ ID NO: 6262 - RNA, 22 nt, Vaccinia virus
uauuuuuguaaaacuuuuuuua

SEQ ID NO: 6263 - RNA, 18 nt, Vaccinia virus
agaaagagaauaaaaaua

SEQ ID NO: 6264 - RNA, 22 nt, Vaccinia virus
ucaauaacuaaauggcggcggc

SEQ ID NO: 6265 - RNA, 21 nt, Vaccinia virus
uauuguugugccaguuauuga

SEQ ID NO: 6266 - RNA, 22 nt, Vaccinia virus
gaaaggauuaauauauucuaug

SEQ ID NO: 6267 - RNA, 21 nt, Vaccinia virus
uauugaguaagaauaccuuuu

SEQ ID NO: 6268 - RNA, 22 nt, Vaccinia virus
ccagaaggaacauacgacauau

SEQ ID NO: 6269 - RNA, 20 nt, Vaccinia virus
augauuucguaucuuucugg

SEQ ID NO: 6270 - RNA, 22 nt, Vaccinia virus
ggaauuggauuuacauuuucag

SEQ ID NO: 6271 - RNA, 22 nt, Vaccinia virus
uagaaaacuaguauccauucag

SEQ ID NO: 6272 - RNA, 22 nt, Vaccinia virus
ugaugccaauaagcuuuagaua

SEQ ID NO: 6273 - RNA, 13 nt, Vaccinia virus
gggaugguauuau

SEQ ID NO: 6274 - RNA, 22 nt, Vaccinia virus
acucauuucauuauaauaguuu

SEQ ID NO: 6275 - RNA, 22 nt, Vaccinia virus
aauuuuaggacggaucaaugag

SEQ ID NO: 6276 - RNA, 22 nt, Vaccinia virus
uugccuguauuguauuagagua

SEQ ID NO: 6277 - RNA, 22 nt, Vaccinia virus
ucugauagaaugcgagcagcga

SEQ ID NO: 6278 - RNA, 22 nt, Vaccinia virus
uuaauuccacaaauuguauaag

SEQ ID NO: 6279 - RNA, 21 nt, Vaccinia virus
uucuaaaagauauggaauuaa

SEQ ID NO: 6280 - RNA, 22 nt, Vaccinia virus
cguauuauacgcauuauaacug

SEQ ID NO: 6281 - RNA, 21 nt, Vaccinia virus
uguuucguuguauauaguacg

SEQ ID NO: 6282 - RNA, 22 nt, Vaccinia virus
uacuuuaugcugaggaccgugu

SEQ ID NO: 6283 - RNA, 22 nt, Vaccinia virus
uuuccuacuacuaaagcaaagg

SEQ ID NO: 6284 - RNA, 22 nt, Vaccinia virus
agauuucagcuucuggaauagg

SEQ ID NO: 6285 - RNA, 21 nt, Vaccinia virus
ucuauaauuuuauugagauuu

SEQ ID NO: 6286 - RNA, 22 nt, Vaccinia virus
uaguaacggcagggguauuaau

SEQ ID NO: 6287 - RNA, 20 nt, Vaccinia virus
aauaauaaaauguuaacuau

SEQ ID NO: 6288 - RNA, 22 nt, Vaccinia virus
uugcguuucacaaacacaggcu

SEQ ID NO: 6289 - RNA, 22 nt, Vaccinia virus
gaucuguauaguaacuauguaa

SEQ ID NO: 6290 - RNA, 22 nt, Vaccinia virus
uagauacuuuacuucauauaaa

SEQ ID NO: 6291 - RNA, 21 nt, Vaccinia virus
uguucaugaaggaguaucuua

SEQ ID NO: 6292 - RNA, 22 nt, Vaccinia virus
uuuaggaaagccuuuaucguug

SEQ ID NO: 6293 - RNA, 22 nt, Vaccinia virus
aagauagacgacucuccaaaga

SEQ ID NO: 6294 - RNA, 22 nt, Vaccinia virus
uggauauagcagccugaagcuc

SEQ ID NO: 6295 - RNA, 22 nt, Vaccinia virus
augaacgaagguuguuuuaagu

SEQ ID NO: 6296 - RNA, 22 nt, Vaccinia virus
uggaacagcucauagaaaauau

SEQ ID NO: 6297 - RNA, 19 nt, Vaccinia virus
guauaauuucguuguucua

SEQ ID NO: 6298 - RNA, 22 nt, Vaccinia virus
uccaacucugucuuugugaugu

SEQ ID NO: 6299 - RNA, 22 nt, Vaccinia virus
gcauccucaaaaaauauauucg

SEQ ID NO: 6300 - RNA, 22 nt, Vaccinia virus
agguuugauuguaauuuuguuu

SEQ ID NO: 6301 - RNA, 20 nt, Vaccinia virus
ucaucuuuaacguuaaaucu

SEQ ID NO: 6302 - RNA, 22 nt, Vaccinia virus
ucuuaucauuggucgguguuug

SEQ ID NO: 6303 - RNA, 22 nt, Vaccinia virus
caucgauucccauaugauguuu

SEQ ID NO: 6304 - RNA, 22 nt, Vaccinia virus
uucugucuuuaagggauuuucu

SEQ ID NO: 6305 - RNA, 21 nt, Vaccinia virus
aaaaaugauuuagacaugaau

SEQ ID NO: 6306 - RNA, 22 nt, Vaccinia virus
uuuuaucuuuaucauaaacuac

SEQ ID NO: 6307 - RNA, 17 nt, Vaccinia virus
uuguguuggcauagaag

SEQ ID NO: 6308 - RNA, 22 nt, Vaccinia virus
uacagugauugcagauuugcca

SEQ ID NO: 6309 - RNA, 22 nt, Vaccinia virus
cgauguaugcaauucacuguau

SEQ ID NO: 6310 - RNA, 22 nt, Vaccinia virus
aauggaguauauuuuugaugac

SEQ ID NO: 6311 - RNA, 22 nt, Vaccinia virus
ucaucuuaaaguagcacucuau

SEQ ID NO: 6312 - RNA, 22 nt, Vaccinia virus
ugaaucuaaaucguauugugaa

SEQ ID NO: 6313 - RNA, 22 nt, Vaccinia virus
ucuaugguauggaaucccgagg

SEQ ID NO: 6314 - RNA, 22 nt, Vaccinia virus
uuggcauuauuaguauucuucu

SEQ ID NO: 6315 - RNA, 20 nt, Vaccinia virus
aaauauacagcaaugcuaua

SEQ ID NO: 6316 - RNA, 22 nt, Vaccinia virus
uauauuugaaaaucguuacggc

SEQ ID NO: 6317 - RNA, 20 nt, Vaccinia virus
augauugcauagugaauaua

SEQ ID NO: 6318 - RNA, 22 nt, Vaccinia virus
uuuuuaaaagguauguagccuu

SEQ ID NO: 6319 - RNA, 22 nt, Vaccinia virus
uacauucucauuaauuaaccau

SEQ ID NO: 6320 - RNA, 22 nt, Vaccinia virus
ucaccguaaauuuaucaccaga

SEQ ID NO: 6321 - RNA, 21 nt, Vaccinia virus
uaucuuuauguccauggugau

SEQ ID NO: 6322 - RNA, 22 nt, Vaccinia virus
ugcguuagaacgcucgucgaua

SEQ ID NO: 6323 - RNA, 22 nt, Vaccinia virus
cauuuuuagagagaacuaacgc

SEQ ID NO: 6324 - RNA, 22 nt, Vaccinia virus
uaagauuaauuucgaauuugua

SEQ ID NO: 6325 - RNA, 22 nt, Vaccinia virus
gacaucacucuucgaaaagaaa

SEQ ID NO: 6326 - RNA, 22 nt, Vaccinia virus
uauuuuuaauaaugguguugau

SEQ ID NO: 6327 - RNA, 21 nt, Vaccinia virus
ucaacacuacaggaaaguaug

SEQ ID NO: 6328 - RNA, 22 nt, Vaccinia virus
cauacguuuacuuuuugcguau

SEQ ID NO: 6329 - RNA, 22 nt, Vaccinia virus
uaucauaaaggguaugcucaug

SEQ ID NO: 6330 - RNA, 22 nt, Vaccinia virus
caacauuaacaucuugaaccgu

SEQ ID NO: 6331 - RNA, 18 nt, Vaccinia virus
auaaauuuauaauguucg

SEQ ID NO: 6332 - RNA, 22 nt, Vaccinia virus
aaugacuuuaucagauuaaaau

SEQ ID NO: 6333 - RNA, 22 nt, Vaccinia virus
uauuuuuuucugaauauauugu

SEQ ID NO: 6334 - RNA, 22 nt, Vaccinia virus
ccauuaauaucucuauuauagc

SEQ ID NO: 6335 - RNA, 13 nt, Vaccinia virus
ccagaauuaaugg

SEQ ID NO: 6336 - RNA, 22 nt, Vaccinia virus
agcaguuacaagauuuuuagcg

SEQ ID NO: 6337 - RNA, 20 nt, Vaccinia virus
uguguuauuuuuuaacugcu

SEQ ID NO: 6338 - RNA, 22 nt, Vaccinia virus
uauuuuuacaaaaaaaauguau

SEQ ID NO: 6339 - RNA, 20 nt, Vaccinia virus
uauguauauuuauaaaaaug

SEQ ID NO: 6340 - RNA, 22 nt, Vaccinia virus
uauuuuuacaaaaaaaauguau

SEQ ID NO: 6341 - RNA, 20 nt, Vaccinia virus
uauguauauuuauaaaaaug

SEQ ID NO: 6342 - RNA, 22 nt, Vaccinia virus
gauuuuaaccaguauguuuaau

SEQ ID NO: 6343 - RNA, 22 nt, Vaccinia virus
aaacauaacauauuuugagauu

SEQ ID NO: 6344 - RNA, 22 nt, Vaccinia virus
ucaguauuuuaucuagacaauu

SEQ ID NO: 6345 - RNA, 22 nt, Vaccinia virus
guuggauuauuuuacauaucua

SEQ ID NO: 6346 - RNA, 22 nt, Vaccinia virus
uucugguuccuuaaaucuggug

SEQ ID NO: 6347 - RNA, 22 nt, Vaccinia virus
guauauaauaaacuagauuaug

SEQ ID NO: 6348 - RNA, 22 nt, Vaccinia virus
aagaucugguacugguucgaac

SEQ ID NO: 6349 - RNA, 20 nt, Vaccinia virus
caucaucgguaguagauuuu

SEQ ID NO: 6350 - RNA, 22 nt, Vaccinia virus
gaauguuugacugugccuaaua

SEQ ID NO: 6351 - RNA, 21 nt, Vaccinia virus
uaaugcugaauaaaaauauuu

SEQ ID NO: 6352 - RNA, 22 nt, Vaccinia virus
uggcgacgguucaguauuugcu

SEQ ID NO: 6353 - RNA, 22 nt, Vaccinia virus
caaauguugaugaaucacguug

SEQ ID NO: 6354 - RNA, 22 nt, Vaccinia virus
uagacgaaauagauuauuuaac

SEQ ID NO: 6355 - RNA, 22 nt, Vaccinia virus
ggugucaaacuguguagcuaga

SEQ ID NO: 6356 - RNA, 22 nt, Vaccinia virus
uaguggguguagcaauuauucu

SEQ ID NO: 6357 - RNA, 21 nt, Vaccinia virus
uguagcuauuuguucuauuag

SEQ ID NO: 6358 - RNA, 22 nt, Vaccinia virus
uacuuauucauaggugguaaua

SEQ ID NO: 6359 - RNA, 22 nt, Vaccinia virus
uacugaaaauauguaucaagua

SEQ ID NO: 6360 - RNA, 22 nt, Vaccinia virus
ugcugagaaagaaaaaguuaag

SEQ ID NO: 6361 - RNA, 22 nt, Vaccinia virus
acuagaacgugaucgguaucuu

SEQ ID NO: 6362 - RNA, 22 nt, Vaccinia virus
uuaucuauagcaucuacuaacu

SEQ ID NO: 6363 - RNA, 22 nt, Vaccinia virus
ucuagaccauguaccuuagaua

SEQ ID NO: 6364 - RNA, 22 nt, Vaccinia virus
ugguaaaaagacucuucgucuu

SEQ ID NO: 6365 - RNA, 22 nt, Vaccinia virus
acggaaauaguugucaagauuc

SEQ ID NO: 6366 - RNA, 22 nt, Vaccinia virus
uggguacucccggaggcggauc

SEQ ID NO: 6367 - RNA, 22 nt, Vaccinia virus
cgccacccauauuuaucucauu

SEQ ID NO: 6368 - RNA, 22 nt, Vaccinia virus
uggucuuagcgcaucagauguu

SEQ ID NO: 6369 - RNA, 22 nt, Vaccinia virus
cauuuuuaugacguugguucca

SEQ ID NO: 6370 - RNA, 22 nt, Vaccinia virus
uuuccucuucagucuucucaca

SEQ ID NO: 6371 - RNA, 21 nt, Vaccinia virus
uggaguagaugauagagggga

SEQ ID NO: 6372 - RNA, 22 nt, Vaccinia virus
gcuucuaaucagauguucuaau

SEQ ID NO: 6373 - RNA, 22 nt, Vaccinia virus
ucauugaccauuugucuggcua

SEQ ID NO: 6374 - RNA, 22 nt, Vaccinia virus
uaauggaguucgcauuugugua

SEQ ID NO: 6375 - RNA, 22 nt, Vaccinia virus
ugcguuuauaucauuuccguua

SEQ ID NO: 6376 - RNA, 22 nt, Vaccinia virus
uaacuaaauuguaguguauaua

SEQ ID NO: 6377 - RNA, 22 nt, Vaccinia virus
uguuucuauuuuuuugacaguu

SEQ ID NO: 6378 - RNA, 22 nt, Vaccinia virus
ucuaaacguuucuguuagauug

SEQ ID NO: 6379 - RNA, 22 nt, Vaccinia virus
auucuaccaguuuguugaaaua

SEQ ID NO: 6380 - RNA, 22 nt, Vaccinia virus
gcuuugaguuuuguugaaucga

SEQ ID NO: 6381 - RNA, 20 nt, Vaccinia virus
ucgguugcaccuucagaugc

SEQ ID NO: 6382 - RNA, 22 nt, Vaccinia virus
aaaauauuuuuguaaaacuuuu

SEQ ID NO: 6383 - RNA, 20 nt, Vaccinia virus
agaaagagguuuaauauuuu

SEQ ID NO: 6384 - RNA, 22 nt, Vaccinia virus
ccaaaacauuuuuagacgauuc

SEQ ID NO: 6385 - RNA, 16 nt, Vaccinia virus
uggcgauugauuuugg

SEQ ID NO: 6386 - RNA, 22 nt, Vaccinia virus
agugauaauauauuuuaaauuu

SEQ ID NO: 6387 - RNA, 19 nt, Vaccinia virus
uugaauaauauguauuacu

SEQ ID NO: 6388 - RNA, 22 nt, Vaccinia virus
cauuagaaugggaauuuuuuau

SEQ ID NO: 6389 - RNA, 20 nt, Vaccinia virus
cgguagauccccaucuaaug

SEQ ID NO: 6390 - RNA, 22 nt, Vaccinia virus
uaaagauauugacuuggauggu

SEQ ID NO: 6391 - RNA, 20 nt, Vaccinia virus
aaacaucuuugaaaucuuua

SEQ ID NO: 6392 - RNA, 22 nt, Vaccinia virus
acagaaaccaugccguguagaa

SEQ ID NO: 6393 - RNA, 22 nt, Vaccinia virus
ucacgcgguuauuucagucgug

SEQ ID NO: 6394 - RNA, 22 nt, Vaccinia virus
ugaauaauauacauaucauacg

SEQ ID NO: 6395 - RNA, 14 nt, Vaccinia virus
ugauuuauauucgu

SEQ ID NO: 6396 - RNA, 22 nt, Vaccinia virus
ucaacauaaucaaugagccagg

SEQ ID NO: 6397 - RNA, 16 nt, Vaccinia virus
uauuggguaguguuga

SEQ ID NO: 6398 - RNA, 22 nt, Vaccinia virus
uuucacaaauggauguuaaugu

SEQ ID NO: 6399 - RNA, 15 nt, Vaccinia virus
ugacgcuaguggaau

SEQ ID NO: 6400 - RNA, 22 nt, Vaccinia virus
ucgucuaaacgaauauuaggua

SEQ ID NO: 6401 - RNA, 20 nt, Vaccinia virus
gccaaaacuucacagacgau

SEQ ID NO: 6402 - RNA, 22 nt, Vaccinia virus
agucaauaaggaauuaauuuua

SEQ ID NO: 6403 - RNA, 21 nt, Vaccinia virus
gucuuaacccauucguugauu

SEQ ID NO: 6404 - RNA, 22 nt, Vaccinia virus
uucguguacucauauauuuugc

SEQ ID NO: 6405 - RNA, 22 nt, Vaccinia virus
aucaauauauggcauaaaacac

SEQ ID NO: 6406 - RNA, 22 nt, Vaccinia virus
uucguguacucauauauuuugc

SEQ ID NO: 6407 - RNA, 22 nt, Vaccinia virus
aucaauauauggcauaaaacac

SEQ ID NO: 6408 - RNA, 22 nt, Vaccinia virus
agauuguacaaguauuccaagu

SEQ ID NO: 6409 - RNA, 13 nt, Vaccinia virus
uaggagauaaucu

SEQ ID NO: 6410 - RNA, 22 nt, Vaccinia virus
aauggauacuaguuuucuaagu

SEQ ID NO: 6411 - RNA, 16 nt, Vaccinia virus
aaauguaaauccaauu

SEQ ID NO: 6412 - RNA, 22 nt, Vaccinia virus
ugauauagauuaucucuuaaaa

SEQ ID NO: 6413 - RNA, 21 nt, Vaccinia virus
agacgaugauggaaauauuau

SEQ ID NO: 6414 - RNA, 22 nt, Vaccinia virus
agagauaggucuaacgccuauu

SEQ ID NO: 6415 - RNA, 22 nt, Vaccinia virus
gauuaguuagacugaaugcuuu

SEQ ID NO: 6416 - RNA, 22 nt, Vaccinia virus
uguaaagaugaaaaaguaaauu

SEQ ID NO: 6417 - RNA, 22 nt, Vaccinia virus
uucguuaguucauccauucagu

SEQ ID NO: 6418 - RNA, 22 nt, Vaccinia virus
acgaccaauaaauauauucagu

SEQ ID NO: 6419 - RNA, 22 nt, Vaccinia virus
ugacgucaucaauacuggucag

SEQ ID NO: 6420 - RNA, 22 nt, Vaccinia virus
uaauaauaucauuuacaauuaa

SEQ ID NO: 6421 - RNA, 20 nt, Vaccinia virus
aauuaaacaaaucguuauua

SEQ ID NO: 6422 - RNA, 22 nt, Vaccinia virus
uuguauucugaaggauugagua

SEQ ID NO: 6423 - RNA, 21 nt, Vaccinia virus
ucgauaaucggucaacaaucu

SEQ ID NO: 6424 - RNA, 22 nt, Vaccinia virus
uaaaugauucaaccaugagugu

SEQ ID NO: 6425 - RNA, 13 nt, Vaccinia virus
cucaugcauuugu

SEQ ID NO: 6426 - RNA, 22 nt, Vaccinia virus
uauuuuuauucucuuucucucu

SEQ ID NO: 6427 - RNA, 22 nt, Vaccinia virus
uauuuuuauucucuuucucucu

SEQ ID NO: 6428 - RNA, 22 nt, Vaccinia virus
uuauauagcgcuuacgauuaua

SEQ ID NO: 6429 - RNA, 22 nt, Vaccinia virus
aguuaauuaagacagauauuag

SEQ ID NO: 6430 - RNA, 22 nt, Vaccinia virus
uagguacauaaugcggacuauc

SEQ ID NO: 6431 - RNA, 21 nt, Vaccinia virus
uaguaucguaucauuaucugu

SEQ ID NO: 6432 - RNA, 22 nt, Vaccinia virus
uauucuucauaaucuacuuuau

SEQ ID NO: 6433 - RNA, 18 nt, Vaccinia virus
uugaugucauaaagaaug

SEQ ID NO: 6434 - RNA, 22 nt, Vaccinia virus
aaaaagucauguuggaacagug

SEQ ID NO: 6435 - RNA, 15 nt, Vaccinia virus
aaaaaauuacuuuuu

SEQ ID NO: 6436 - RNA, 22 nt, Vaccinia virus
aauuagucauuuuuccaucaca

SEQ ID NO: 6437 - RNA, 20 nt, Vaccinia virus
uugagagaaaaaaacuaauu

SEQ ID NO: 6438 - RNA, 22 nt, Vaccinia virus
ugaucuacacacagacgaugga

SEQ ID NO: 6439 - RNA, 21 nt, Vaccinia virus
uauacgaucugacuagauacg

SEQ ID NO: 6440 - RNA, 22 nt, Vaccinia virus
gagaguacacuaauccacaaaa

SEQ ID NO: 6441 - RNA, 13 nt, Vaccinia virus
uggauuuauuuuc

SEQ ID NO: 6442 - RNA, 22 nt, Vaccinia virus
ucaucuccagaggaaauauccu

SEQ ID NO: 6443 - RNA, 22 nt, Vaccinia virus
aagaucuauuuccagaugauga

SEQ ID NO: 6444 - RNA, 22 nt, Vaccinia virus
acacagcaauagaucggaugau

SEQ ID NO: 6445 - RNA, 22 nt, Vaccinia virus
uaguauaucaaagaucuuguua

SEQ ID NO: 6446 - RNA, 22 nt, Vaccinia virus
uaaaugccgauauuuguuaaua

SEQ ID NO: 6447 - RNA, 22 nt, Vaccinia virus
aagaauauauuagcauugucua

SEQ ID NO: 6448 - RNA, 22 nt, Vaccinia virus
uaauaucgguaguuguaucauc

SEQ ID NO: 6449 - RNA, 20 nt, Vaccinia virus
augaauaauauuaauauuag

SEQ ID NO: 6450 - RNA, 22 nt, Vaccinia virus
ucagcucgugugguuccaaugu

SEQ ID NO: 6451 - RNA, 18 nt, Vaccinia virus
uugguaacaaagcucgac

SEQ ID NO: 6452 - RNA, 22 nt, Vaccinia virus
aacuaaucauugauagagaagu

SEQ ID NO: 6453 - RNA, 22 nt, Vaccinia virus
ggacucucuggagauagugaac

SEQ ID NO: 6454 - RNA, 22 nt, Vaccinia virus
uauuauacgaucuacguuuuau

SEQ ID NO: 6455 - RNA, 20 nt, Vaccinia virus
cguguaaauuauaaacauua

SEQ ID NO: 6456 - RNA, 22 nt, Vaccinia virus
uauuauacgaucuacguuuuau

SEQ ID NO: 6457 - RNA, 20 nt, Vaccinia virus
cguguaaauuauaaacauua

SEQ ID NO: 6458 - RNA, 22 nt, Vaccinia virus
agguguacuauaguugacagua

SEQ ID NO: 6459 - RNA, 20 nt, Vaccinia virus
uauaggucaucauuauauuu

SEQ ID NO: 6460 - RNA, 22 nt, Vaccinia virus
uauccgcuuuauuuguaauuga

SEQ ID NO: 6461 - RNA, 19 nt, Vaccinia virus
auacaaacuuaacggauau

SEQ ID NO: 6462 - RNA, 22 nt, Vaccinia virus
uaaaaacuuuuagaaauauaca

SEQ ID NO: 6463 - RNA, 18 nt, Vaccinia virus
ucuauaucuucuuuuuau

SEQ ID NO: 6464 - RNA, 22 nt, Vaccinia virus
gaauuauggcaucuuaaaacug

SEQ ID NO: 6465 - RNA, 22 nt, Vaccinia virus
gugucuagaacaguggauaguu

SEQ ID NO: 6466 - RNA, 22 nt, Vaccinia virus
gagcguaugaaauugucgauau

SEQ ID NO: 6467 - RNA, 22 nt, Vaccinia virus
ccgaaaaugaauugcgugacua

SEQ ID NO: 6468 - RNA, 22 nt, Vaccinia virus
cauggcugauaaaccucaugaa

SEQ ID NO: 6469 - RNA, 19 nt, Vaccinia virus
gguuguuauggcuuaugug

SEQ ID NO: 6470 - RNA, 22 nt, Vaccinia virus
gaagguaguaauguuaguagac

SEQ ID NO: 6471 - RNA, 20 nt, Vaccinia virus
auaguuuaucauauaccuuu

SEQ ID NO: 6472 - RNA, 22 nt, Vaccinia virus
agaagcguguuauuguuccaua

SEQ ID NO: 6473 - RNA, 22 nt, Vaccinia virus
ugggaucagguaaaacaauaau

SEQ ID NO: 6474 - RNA, 22 nt, Vaccinia virus
uggacauuauagguuuuaauag

SEQ ID NO: 6475 - RNA, 20 nt, Vaccinia virus
uggaauaagauauuguucgu

SEQ ID NO: 6476 - RNA, 22 nt, Vaccinia virus
ucauauucgucucuaguauaaa

SEQ ID NO: 6477 - RNA, 22 nt, Vaccinia virus
uauucagauuaucaugcgaugu

SEQ ID NO: 6478 - RNA, 22 nt, Vaccinia virus
uuagcuaauauuaguacuauau

SEQ ID NO: 6479 - RNA, 22 nt, Vaccinia virus
auccgguauuaauguuuuuauu

SEQ ID NO: 6480 - RNA, 22 nt, Vaccinia virus
ugauaguaaaaaagaaagaguc

SEQ ID NO: 6481 - RNA, 22 nt, Vaccinia virus
uuuuucccacccaacuauaagu

SEQ ID NO: 6482 - RNA, 22 nt, Vaccinia virus
acuaugauauuauguugauuuc

SEQ ID NO: 6483 - RNA, 18 nt, Vaccinia virus
guuaauauauuucauggu

SEQ ID NO: 6484 - RNA, 22 nt, Vaccinia virus
gagcaaauaucggaauaaguag

SEQ ID NO: 6485 - RNA, 22 nt, Vaccinia virus
uccguuuugcacguaaccauuc

SEQ ID NO: 6486 - RNA, 22 nt, Vaccinia virus
gggauauuauuuagugauuuau

SEQ ID NO: 6487 - RNA, 20 nt, Vaccinia virus
uaaagacuuuaauauauccu

SEQ ID NO: 6488 - RNA, 22 nt, Vaccinia virus
uugauauauuuacaaaaggcau

SEQ ID NO: 6489 - RNA, 21 nt, Vaccinia virus
ugucuacugacuacuauuaau

SEQ ID NO: 6490 - RNA, 22 nt, Vaccinia virus
ucaauauugaaaauacuaauug

SEQ ID NO: 6491 - RNA, 22 nt, Vaccinia virus
cgaguauugaaacuauauaugg

SEQ ID NO: 6492 - RNA, 22 nt, Vaccinia virus
uugacaauucucuuugagccga

SEQ ID NO: 6493 - RNA, 22 nt, Vaccinia virus
cagugaaaagaauguaaacuuu

SEQ ID NO: 6494 - RNA, 22 nt, Vaccinia virus
ugcauauauuagagaagauugu

SEQ ID NO: 6495 - RNA, 22 nt, Vaccinia virus
agcuauaauaauaaauguaucc

SEQ ID NO: 6496 - RNA, 22 nt, Vaccinia virus
uuguuauuuuacacaucuuggu

SEQ ID NO: 6497 - RNA, 20 nt, Vaccinia virus
uauccuguuaagagaauaau

SEQ ID NO: 6498 - RNA, 22 nt, Vaccinia virus
uaucuaagguacauggucuaga

SEQ ID NO: 6499 - RNA, 21 nt, Vaccinia virus
aguuaguagaugcuauagaua

SEQ ID NO: 6500 - RNA, 22 nt, Vaccinia virus
ucauaacgucauugaugaugug

SEQ ID NO: 6501 - RNA, 22 nt, Vaccinia virus
uacgguaucuaauauagauuuu

SEQ ID NO: 6502 - RNA, 22 nt, Vaccinia virus
ucuauuccaggauuaaaaacuu

SEQ ID NO: 6503 - RNA, 22 nt, Vaccinia virus
uuagguuuauaccucaagaauc

SEQ ID NO: 6504 - RNA, 22 nt, Vaccinia virus
ucuuuucgaagagugaugucug

SEQ ID NO: 6505 - RNA, 22 nt, Vaccinia virus
aaacauacaaauucgaaauuaa

SEQ ID NO: 6506 - RNA, 22 nt, Vaccinia virus
uuuuuuacgacuccaucagaaa

SEQ ID NO: 6507 - RNA, 20 nt, Vaccinia virus
uugugagaccaucgaagaga

SEQ ID NO: 6508 - RNA, 22 nt, Vaccinia virus
uuuuuuacgacuccaucagaaa

SEQ ID NO: 6509 - RNA, 20 nt, Vaccinia virus
uugugagaccaucgaagaga

SEQ ID NO: 6510 - RNA, 22 nt, Vaccinia virus
uuuuuuacgacuccaucagaaa

SEQ ID NO: 6511 - RNA, 20 nt, Vaccinia virus
uugugagaccaucgaagaga

SEQ ID NO: 6512 - RNA, 22 nt, Vaccinia virus
uacuaaaacuuauauauuauua

SEQ ID NO: 6513 - RNA, 22 nt, Vaccinia virus
aauuauauauauaauuuuauaa

SEQ ID NO: 6514 - RNA, 22 nt, Vaccinia virus
cguaauaauaugccgaugaaau

SEQ ID NO: 6515 - RNA, 22 nt, Vaccinia virus
gaugaaaauaaucgcauaguua

SEQ ID NO: 6516 - RNA, 22 nt, Vaccinia virus
aggcacaaugaaugauauagcc

SEQ ID NO: 6517 - RNA, 18 nt, Vaccinia virus
uucagcgcaaaguguccu

SEQ ID NO: 6518 - RNA, 22 nt, Vaccinia virus
aguaggauuauguaacaucagc

SEQ ID NO: 6519 - RNA, 22 nt, Vaccinia virus
uggguuauuuagucuuacacau

SEQ ID NO: 6520 - RNA, 22 nt, Vaccinia virus
ucgucuaaacgaauauuaggua

SEQ ID NO: 6521 - RNA, 20 nt, Vaccinia virus
agccaaaacuucacagacga

SEQ ID NO: 6522 - RNA, 22 nt, Vaccinia virus
aaauacacgaugguaaauuaau

SEQ ID NO: 6523 - RNA, 22 nt, Vaccinia virus
aucaaucauccucaguuaauuu

SEQ ID NO: 6524 - RNA, 22 nt, Vaccinia virus
agugguaggucauacuccauca

SEQ ID NO: 6525 - RNA, 22 nt, Vaccinia virus
agcuuauauggcaacgacuauu

SEQ ID NO: 6526 - RNA, 22 nt, Vaccinia virus
gacaaaauuaaaaguucuaccu

SEQ ID NO: 6527 - RNA, 19 nt, Vaccinia virus
uuggauuuuguuauuuguc

SEQ ID NO: 6528 - RNA, 22 nt, Vaccinia virus
ugauugauaccuuuguacgaca

SEQ ID NO: 6529 - RNA, 18 nt, Vaccinia virus
uguuggccgaagcaauua

SEQ ID NO: 6530 - RNA, 22 nt, Vaccinia virus
ugccaaauauaugguaaccgau

SEQ ID NO: 6531 - RNA, 16 nt, Vaccinia virus
uaccucaaauuggaca

SEQ ID NO: 6532 - RNA, 22 nt, Vaccinia virus
uggagagucgucuaucuuugua

SEQ ID NO: 6533 - RNA, 22 nt, Vaccinia virus
uagcaacgauaaaggcuuuccu

SEQ ID NO: 6534 - RNA, 22 nt, Vaccinia virus
ucuaaauauuuuuuagagaauc

SEQ ID NO: 6535 - RNA, 22 nt, Vaccinia virus
ucuuuuccaaguacgguaauag

SEQ ID NO: 6536 - RNA, 22 nt, Vaccinia virus
uugaacauaaaacuaauauuuu

SEQ ID NO: 6537 - RNA, 22 nt, Vaccinia virus
uucaaaauuauuuaccauccca

SEQ ID NO: 6538 - RNA, 22 nt, Vaccinia virus
uauuuacucccgcagcacaaug

SEQ ID NO: 6539 - RNA, 22 nt, Vaccinia virus
uuucguugaucacauuuagaua

SEQ ID NO: 6540 - RNA, 22 nt, Vaccinia virus
aaggaacuaaucaacgaauggg

SEQ ID NO: 6541 - RNA, 20 nt, Vaccinia virus
aaugguaaaauuaauuccuu

SEQ ID NO: 6542 - RNA, 22 nt, Vaccinia virus
ucgucguacccaccgagagcgu

SEQ ID NO: 6543 - RNA, 22 nt, Vaccinia virus
ugauuucgguuguacacacgag

SEQ ID NO: 6544 - RNA, 22 nt, Vaccinia virus
acaauucauagcuguauuuuga

SEQ ID NO: 6545 - RNA, 16 nt, Vaccinia virus
aauaucuuccaauugu

SEQ ID NO: 6546 - RNA, 22 nt, Vaccinia virus
uccucuauaauauucccagaaa

SEQ ID NO: 6547 - RNA, 22 nt, Vaccinia virus
gaucugaucuguucauauacgc

SEQ ID NO: 6548 - RNA, 22 nt, Vaccinia virus
uccauacguugaagauuuuuua

SEQ ID NO: 6549 - RNA, 21 nt, Vaccinia virus
aagacuugggaauauaugcga

SEQ ID NO: 6550 - RNA, 22 nt, Vaccinia virus
caggaucuagauaauuaauaau

SEQ ID NO: 6551 - RNA, 20 nt, Vaccinia virus
uucuuauucuuuguauuuug

SEQ ID NO: 6552 - RNA, 22 nt, Vaccinia virus
gaucaucucuuugcuaucuucu

SEQ ID NO: 6553 - RNA, 20 nt, Vaccinia virus
uaaaugaugcaaaaaugauu

SEQ ID NO: 6554 - RNA, 22 nt, Vaccinia virus
uuguaacuuuucauacacugua

SEQ ID NO: 6555 - RNA, 22 nt, Vaccinia virus
caguauuuaccauuugauuaau

SEQ ID NO: 6556 - RNA, 22 nt, Vaccinia virus
uauuaguuaaauauuaaaacuu

SEQ ID NO: 6557 - RNA, 22 nt, Vaccinia virus
acuuaaaauuuaaaaugauauu

SEQ ID NO: 6558 - RNA, 22 nt, Vaccinia virus
cgacgaguuuacuuuuacgcuc

SEQ ID NO: 6559 - RNA, 22 nt, Vaccinia virus
gcacuguucuaugagaucgucg

SEQ ID NO: 6560 - RNA, 22 nt, Vaccinia virus
cagauuguaguucuauaaucgu

SEQ ID NO: 6561 - RNA, 22 nt, Vaccinia virus
ccuauauuauauguuugagucu

SEQ ID NO: 6562 - RNA, 22 nt, Vaccinia virus
uacuuggaucuuuuguacaucg

SEQ ID NO: 6563 - RNA, 21 nt, Vaccinia virus
ucacuacaauaauuacaagua

SEQ ID NO: 6564 - RNA, 22 nt, Vaccinia virus
uuucugcuauuauacccgcuau

SEQ ID NO: 6565 - RNA, 22 nt, Vaccinia virus
uagcgucguuuaagagcagaua

SEQ ID NO: 6566 - RNA, 22 nt, Vaccinia virus
gguggaggucugagaaugaacu

SEQ ID NO: 6567 - RNA, 18 nt, Vaccinia virus
uccaucucagaauccgcu

SEQ ID NO: 6568 - RNA, 22 nt, Vaccinia virus
ucguuaggaauuuuaguauucu

SEQ ID NO: 6569 - RNA, 14 nt, Vaccinia virus
ggaagaaguaaugg

SEQ ID NO: 6570 - RNA, 22 nt, Vaccinia virus
gcgacgguucaguauuugcugc

SEQ ID NO: 6571 - RNA, 22 nt, Vaccinia virus
gcaaauguugaugaaucacguu

SEQ ID NO: 6572 - RNA, 22 nt, Vaccinia virus
agguuaauaauauuauagauau

SEQ ID NO: 6573 - RNA, 22 nt, Vaccinia virus
ucggagaauguucggcuccgcc

SEQ ID NO: 6574 - RNA, 22 nt, Vaccinia virus
uucaaauguuucauuaacuacg

SEQ ID NO: 6575 - RNA, 22 nt, Vaccinia virus
uaaaauuaaugaugcauuaauu

SEQ ID NO: 6576 - RNA, 22 nt, Vaccinia virus
uagcacuaugauuuacuuuacc

SEQ ID NO: 6577 - RNA, 20 nt, Vaccinia virus
guucaucauccccgucgcua

SEQ ID NO: 6578 - RNA, 22 nt, Vaccinia virus
ugaauguuuccauaccccauuc

SEQ ID NO: 6579 - RNA, 15 nt, Vaccinia virus
gagaugaaucguuca

SEQ ID NO: 6580 - RNA, 22 nt, Vaccinia virus
ggauuguccggcauaucaugua

SEQ ID NO: 6581 - RNA, 22 nt, Vaccinia virus
caucguauacucgaccaucuac

SEQ ID NO: 6582 - RNA, 22 nt, Vaccinia virus
uuaucuacaagaacaaauccgu

SEQ ID NO: 6583 - RNA, 20 nt, Vaccinia virus
auaucguucuuuuugauaau

SEQ ID NO: 6584 - RNA, 22 nt, Vaccinia virus
uuugauuagacaaaugcguaug

SEQ ID NO: 6585 - RNA, 20 nt, Vaccinia virus
ccauucacaauaucaaaaug

SEQ ID NO: 6586 - RNA, 22 nt, Vaccinia virus
uuuuaugaagagccgcguuuaa

SEQ ID NO: 6587 - RNA, 22 nt, Vaccinia virus
ucuccgaacguagcucucuuaa

SEQ ID NO: 6588 - RNA, 22 nt, Vaccinia virus
uuuauaucccguacaucuauuu

SEQ ID NO: 6589 - RNA, 19 nt, Vaccinia virus
uaauguaugguccuauaaa

SEQ ID NO: 6590 - RNA, 22 nt, Vaccinia virus
uaaaugucaaguuuuuccauau

SEQ ID NO: 6591 - RNA, 21 nt, Vaccinia virus
ucgugcuauuagaguuauuua

SEQ ID NO: 6592 - RNA, 22 nt, Vaccinia virus
cccauuucucuaguaaguaucu

SEQ ID NO: 6593 - RNA, 20 nt, Vaccinia virus
uaaaauaucuucaugguggg

SEQ ID NO: 6594 - RNA, 22 nt, Vaccinia virus
uaauauuuagacauagauaaac

SEQ ID NO: 6595 - RNA, 22 nt, Vaccinia virus
ucuauuuguuuauauuuauugc

SEQ ID NO: 6596 - RNA, 22 nt, Vaccinia virus
gaacuuuuuaaguaaucccaac

SEQ ID NO: 6597 - RNA, 22 nt, Vaccinia virus
ggauaauagucacuugcaucua

SEQ ID NO: 6598 - RNA, 22 nt, Vaccinia virus
gaaucguucgauuaacccuacu

SEQ ID NO: 6599 - RNA, 19 nt, Vaccinia virus
ugaauagaguuaucgauuc

SEQ ID NO: 6600 - RNA, 22 nt, Vaccinia virus
uauaaaugucuuugucgaugau

SEQ ID NO: 6601 - RNA, 22 nt, Vaccinia virus
uauauccagagauaucuuguaa

SEQ ID NO: 6602 - RNA, 22 nt, Vaccinia virus
ucaucaucuggaaauagaucuu

SEQ ID NO: 6603 - RNA, 21 nt, Vaccinia virus
ggauauuuccucuggagauga

SEQ ID NO: 6604 - RNA, 22 nt, Vaccinia virus
cauucaugucuaaaucauuuuu

SEQ ID NO: 6605 - RNA, 20 nt, Vaccinia virus
aaucccuuaaagacagaaug

SEQ ID NO: 6606 - RNA, 22 nt, Vaccinia virus
uauacacaucucuucaucggua

SEQ ID NO: 6607 - RNA, 18 nt, Vaccinia virus
ucgugaacaggugguaua

SEQ ID NO: 6608 - RNA, 22 nt, Vaccinia virus
uacagagcuuuauuaacuucuc

SEQ ID NO: 6609 - RNA, 18 nt, Vaccinia virus
guugucuaguuaguugug

SEQ ID NO: 6610 - RNA, 22 nt, Vaccinia virus
uuccccucuaucaucuacucca

SEQ ID NO: 6611 - RNA, 22 nt, Vaccinia virus
gugagaagacugaagaggaaac

SEQ ID NO: 6612 - RNA, 22 nt, Vaccinia virus
uuagugcaggucguuauucuuc

SEQ ID NO: 6613 - RNA, 22 nt, Vaccinia virus
agaugacggccaacuuuaguac

SEQ ID NO: 6614 - RNA, 22 nt, Vaccinia virus
uggagaacauguuccauuuaua

SEQ ID NO: 6615 - RNA, 18 nt, Vaccinia virus
auggauaacgguacucua

SEQ ID NO: 6616 - RNA, 22 nt, Vaccinia virus
uucuaguugguaauugggauaa

SEQ ID NO: 6617 - RNA, 21 nt, Vaccinia virus
uucuauggcaaccgccagaag

SEQ ID NO: 6618 - RNA, 22 nt, Vaccinia virus
ggaaaaagcuuacaauaaacuc

SEQ ID NO: 6619 - RNA, 19 nt, Vaccinia virus
uauaauuugugaguuuucc

SEQ ID NO: 6620 - RNA, 22 nt, Vaccinia virus
ggauaaaaauuuuuuagaugua

SEQ ID NO: 6621 - RNA, 20 nt, Vaccinia virus
cguucgaugaauuccuaucu

SEQ ID NO: 6622 - RNA, 22 nt, Vaccinia virus
uccauaaaagacgaauaagaua

SEQ ID NO: 6623 - RNA, 20 nt, Vaccinia virus
uuauauaauauuuaaaugga

SEQ ID NO: 6624 - RNA, 22 nt, Vaccinia virus
uaaaauaaaugaguaugaucau

SEQ ID NO: 6625 - RNA, 22 nt, Vaccinia virus
auuuuaucauuaccgcuucauu

SEQ ID NO: 6626 - RNA, 22 nt, Vaccinia virus
ugauaaaauuaaccggauccau

SEQ ID NO: 6627 - RNA, 22 nt, Vaccinia virus
uauccaauagagguugcacugu

SEQ ID NO: 6628 - RNA, 22 nt, Vaccinia virus
cauauaacaauaguuagauaca

SEQ ID NO: 6629 - RNA, 15 nt, Vaccinia virus
ucuaacgagaauaug

SEQ ID NO: 6630 - RNA, 22 nt, Vaccinia virus
uuagaagauccuaauuauguuc

SEQ ID NO: 6631 - RNA, 20 nt, Vaccinia virus
cggcuauaggaaucgcugau

SEQ ID NO: 6632 - RNA, 22 nt, Vaccinia virus
aggcaaauacgauagucuagau

SEQ ID NO: 6633 - RNA, 17 nt, Vaccinia virus
uaauuuauugagugcuu

SEQ ID NO: 6634 - RNA, 22 nt, Vaccinia virus
ugcaaaaccccauagugaaaca

SEQ ID NO: 6635 - RNA, 22 nt, Vaccinia virus
uuuuucacuuuuuauaauuuua

SEQ ID NO: 6636 - RNA, 22 nt, Vaccinia virus
uagagacggcugucuuccaaaa

SEQ ID NO: 6637 - RNA, 20 nt, Vaccinia virus
uucuugaacagcuacuucua

SEQ ID NO: 6638 - RNA, 22 nt, Vaccinia virus
uauuacguuucuucgucccguc

SEQ ID NO: 6639 - RNA, 20 nt, Vaccinia virus
caugacaaaaaaauagauau

SEQ ID NO: 6640 - RNA, 22 nt, Vaccinia virus
acaacaaagcgauuauuguuuu

SEQ ID NO: 6641 - RNA, 22 nt, Vaccinia virus
gaacaauaacacgcuucuguuc

SEQ ID NO: 6642 - RNA, 22 nt, Vaccinia virus
ggaauaucuguuguagcguuug

SEQ ID NO: 6643 - RNA, 22 nt, Vaccinia virus
augucguuucgauagcguuacc

SEQ ID NO: 6644 - RNA, 22 nt, Vaccinia virus
ggaauaucuguuguagcguuug

SEQ ID NO: 6645 - RNA, 22 nt, Vaccinia virus
augucguuucgauagcguuacc

SEQ ID NO: 6646 - RNA, 22 nt, Vaccinia virus
gaagaauagcuauauagaaaau

SEQ ID NO: 6647 - RNA, 14 nt, Vaccinia virus
uggauagcaucuuc

SEQ ID NO: 6648 - RNA, 22 nt, Vaccinia virus
aaugacuuuaucagauuaaaau

SEQ ID NO: 6649 - RNA, 22 nt, Vaccinia virus
uauuuuuuucugaauauauugu

SEQ ID NO: 6650 - RNA, 22 nt, Vaccinia virus
uauuaauaacgugcucauuagg

SEQ ID NO: 6651 - RNA, 19 nt, Vaccinia virus
uugauaauuagauauagua

SEQ ID NO: 6652 - RNA, 21 nt, Vaccinia virus
agagacgcaugaaggcugaac

SEQ ID NO: 6653 - RNA, 22 nt, Vaccinia virus
uuugcauguuaccacuaucaac

SEQ ID NO: 6654 - RNA, 22 nt, Vaccinia virus
uguuucccuugucaucaaauug

SEQ ID NO: 6655 - RNA, 22 nt, Vaccinia virus
uagcgugaaggauaugauaaaa

SEQ ID NO: 6656 - RNA, 22 nt, Vaccinia virus
uaucccauuccaaucaccuuau

SEQ ID NO: 6657 - RNA, 22 nt, Vaccinia virus
ucuacauccucgacugaugugg

SEQ ID NO: 6658 - RNA, 20 nt, Vaccinia virus
uuccaccucgggaucuggau

SEQ ID NO: 6659 - RNA, 22 nt, Vaccinia virus
uguccaagguaaaaucguguuu

SEQ ID NO: 6660 - RNA, 20 nt, Vaccinia virus
aaugaugccaucauagauau

SEQ ID NO: 6661 - RNA, 22 nt, Vaccinia virus
cguauccagucaacacuauguu

SEQ ID NO: 6662 - RNA, 20 nt, Vaccinia virus
auauagcuuucacucauaug

SEQ ID NO: 6663 - RNA, 22 nt, Vaccinia virus
ugucgggccaauaguagcuauu

SEQ ID NO: 6664 - RNA, 22 nt, Vaccinia virus
gugggaacuauggccaaauguu

SEQ ID NO: 6665 - RNA, 22 nt, Vaccinia virus
cacuuauguauuaacuuuguuc

SEQ ID NO: 6666 - RNA, 22 nt, Vaccinia virus
caaaagugaauauauauauguu

SEQ ID NO: 6667 - RNA, 22 nt, Vaccinia virus
gauauccgucauugcaauauuc

SEQ ID NO: 6668 - RNA, 22 nt, Vaccinia virus
uauugauaaaaucuccauucuc

SEQ ID NO: 6669 - RNA, 22 nt, Vaccinia virus
uucguguuuuaugccauauauu

SEQ ID NO: 6670 - RNA, 22 nt, Vaccinia virus
aaaauauaugaguacacgaauc

SEQ ID NO: 6671 - RNA, 22 nt, Vaccinia virus
uucguguuuuaugccauauauu

SEQ ID NO: 6672 - RNA, 22 nt, Vaccinia virus
aaaauauaugaguacacgaauc

SEQ ID NO: 6673 - RNA, 22 nt, Vaccinia virus
ugaaacuuuguccuuuccuaca

SEQ ID NO: 6674 - RNA, 14 nt, Vaccinia virus
gggacuuauuucua

SEQ ID NO: 6675 - RNA, 22 nt, Vaccinia virus
ucguguguacaaccgaaaucau

SEQ ID NO: 6676 - RNA, 22 nt, Vaccinia virus
acgcucucgguggguacgacga

SEQ ID NO: 6677 - RNA, 22 nt, Vaccinia virus
ugccggagaguaaacauugacg

SEQ ID NO: 6678 - RNA, 20 nt, Vaccinia virus
cgcauaacucuaucauggca

SEQ ID NO: 6679 - RNA, 22 nt, Vaccinia virus
aagagauguaacgggaacaggg

SEQ ID NO: 6680 - RNA, 21 nt, Vaccinia virus
uauucuaauacauaauucuuc

SEQ ID NO: 6681 - RNA, 22 nt, Vaccinia virus
uacuguaaaaauagaaacuaua

SEQ ID NO: 6682 - RNA, 22 nt, Vaccinia virus
uaguguagguugguaguagggu

SEQ ID NO: 6683 - RNA, 22 nt, Vaccinia virus
uuccguguguaauaaccuacgc

SEQ ID NO: 6684 - RNA, 21 nt, Vaccinia virus
uggggauauagucagaggaac

SEQ ID NO: 6685 - RNA, 22 nt, Vaccinia virus
uaucgauuuaagugguaaacga

SEQ ID NO: 6686 - RNA, 22 nt, Vaccinia virus
uuuacgcucauuaaugaagaga

SEQ ID NO: 6687 - RNA, 22 nt, Vaccinia virus
ucgguaauacagauagacaauu

SEQ ID NO: 6688 - RNA, 22 nt, Vaccinia virus
uugucuauacauuauuggcggc

SEQ ID NO: 6689 - RNA, 22 nt, Vaccinia virus
uuguagaagauccacaaccaau

SEQ ID NO: 6690 - RNA, 21 nt, Vaccinia virus
aagguuauaaacuauauacaa

SEQ ID NO: 6691 - RNA, 22 nt, Vaccinia virus
uaauggcggaaaacuuuuuaga

SEQ ID NO: 6692 - RNA, 21 nt, Vaccinia virus
uuuuucguguuccaaacauua

SEQ ID NO: 6693 - RNA, 22 nt, Vaccinia virus
uggaggucugagaaugaacuuu

SEQ ID NO: 6694 - RNA, 17 nt, Vaccinia virus
uccaucucagaauccgc

SEQ ID NO: 6695 - RNA, 22 nt, Vaccinia virus
gauaugugauaucuucuauaaa

SEQ ID NO: 6696 - RNA, 21 nt, Vaccinia virus
uauuuacggagaugaaauauc

SEQ ID NO: 6697 - RNA, 22 nt, Vaccinia virus
uuauuucgugaaauaaagucau

SEQ ID NO: 6698 - RNA, 20 nt, Vaccinia virus
cuuauauucgcgucuaguag

SEQ ID NO: 6699 - RNA, 22 nt, Vaccinia virus
ugaaucguucgauuaacccuac

SEQ ID NO: 6700 - RNA, 22 nt, Vaccinia virus
ugaauagaguuaucgauucaga

SEQ ID NO: 6701 - RNA, 22 nt, Vaccinia virus
uauguguauuaucagauaucca

SEQ ID NO: 6702 - RNA, 19 nt, Vaccinia virus
auauuuguaauaucuaugu

SEQ ID NO: 6703 - RNA, 22 nt, Vaccinia virus
gguacuucuuaccaacaucuua

SEQ ID NO: 6704 - RNA, 21 nt, Vaccinia virus
uaaaugacaaugagauguacc

SEQ ID NO: 6705 - RNA, 22 nt, Vaccinia virus
aaauauaacagguaguauacuc

SEQ ID NO: 6706 - RNA, 20 nt, Vaccinia virus
uggguaaaaaaaguuuguuu

SEQ ID NO: 6707 - RNA, 22 nt, Vaccinia virus
uacuuuucuauagccgcagaau

SEQ ID NO: 6708 - RNA, 22 nt, Vaccinia virus
aaacuuuuguacagacuaagua

SEQ ID NO: 6709 - RNA, 22 nt, Vaccinia virus
agauauuaaugucguauuugaa

SEQ ID NO: 6710 - RNA, 22 nt, Vaccinia virus
uaacaucucaaugucuuuauua

SEQ ID NO: 6711 - RNA, 22 nt, Vaccinia virus
agagauuagaguuuguacauua

SEQ ID NO: 6712 - RNA, 22 nt, Vaccinia virus
gcuacaaacuuuuccuuuuuca

SEQ ID NO: 6713 - RNA, 22 nt, Vaccinia virus
uaaauuuguggaacuguuaagu

SEQ ID NO: 6714 - RNA, 22 nt, Vaccinia virus
cauugaccaaucagaauuuuau

SEQ ID NO: 6715 - RNA, 22 nt, Vaccinia virus
gaguuuaaaacuuuguauaauc

SEQ ID NO: 6716 - RNA, 22 nt, Vaccinia virus
uaguuauuuacaaaaauuagcu

SEQ ID NO: 6717 - RNA, 22 nt, Vaccinia virus
gcugguacguguaccguaucca

SEQ ID NO: 6718 - RNA, 20 nt, Vaccinia virus
gauaacauuacaacccaguc

SEQ ID NO: 6719 - RNA, 22 nt, Vaccinia virus
ucgucuauagauguggacaaac

SEQ ID NO: 6720 - RNA, 19 nt, Vaccinia virus
uccaacauaaaaacgauga

SEQ ID NO: 6721 - RNA, 22 nt, Vaccinia virus
ucuauauuauuaaaguacguaa

SEQ ID NO: 6722 - RNA, 20 nt, Vaccinia virus
uuuauuauuuaauuuuagau

SEQ ID NO: 6723 - RNA, 22 nt, Vaccinia virus
ugaucuauuucguccauaaaca

SEQ ID NO: 6724 - RNA, 22 nt, Vaccinia virus
uggaggcgaugaucuuaauuuu

SEQ ID NO: 6725 - RNA, 22 nt, Vaccinia virus
aauauucaagaugauaauauug

SEQ ID NO: 6726 - RNA, 17 nt, Vaccinia virus
uauucguuuucuauguu

SEQ ID NO: 6727 - RNA, 22 nt, Vaccinia virus
gaugcgugagucuugcauucau

SEQ ID NO: 6728 - RNA, 22 nt, Vaccinia virus
ugagggucagauccaaauauug

SEQ ID NO: 6729 - RNA, 22 nt, Vaccinia virus
ugugaucaucuucauaggauua

SEQ ID NO: 6730 - RNA, 20 nt, Vaccinia virus
gugccgccugaaguuucaua

SEQ ID NO: 6731 - RNA, 22 nt, Vaccinia virus
uauucucauccauuuuaggaua

SEQ ID NO: 6732 - RNA, 21 nt, Vaccinia virus
ucccuaauaacuucgugaaua

SEQ ID NO: 6733 - RNA, 22 nt, Vaccinia virus
gauguuguaaaguguacgaagc

SEQ ID NO: 6734 - RNA, 20 nt, Vaccinia virus
gcauuugaugcacccacguu

SEQ ID NO: 6735 - RNA, 22 nt, Vaccinia virus
uuguuuguauucauucaauguc

SEQ ID NO: 6736 - RNA, 22 nt, Vaccinia virus
guuuagagucgaauacugcaau

SEQ ID NO: 6737 - RNA, 22 nt, Vaccinia virus
gaccauucgauuuaauaaaaaa

SEQ ID NO: 6738 - RNA, 13 nt, Vaccinia virus
uaaaucguugguc

SEQ ID NO: 6739 - RNA, 22 nt, Vaccinia virus
acuauuuucguaacuggcggau

SEQ ID NO: 6740 - RNA, 22 nt, Vaccinia virus
acucuaauagcacgaucguggu

SEQ ID NO: 6741 - RNA, 22 nt, Vaccinia virus
ccgaaauugauguguuaccguu

SEQ ID NO: 6742 - RNA, 22 nt, Vaccinia virus
aauacauaucuagagaugaauu

SEQ ID NO: 6743 - RNA, 22 nt, Vaccinia virus
uauauuuaugguauuuccuauc

SEQ ID NO: 6744 - RNA, 22 nt, Vaccinia virus
uaaguuaucaagucaucauaag

SEQ ID NO: 6745 - RNA, 22 nt, Vaccinia virus
uuagugacgaaucaagugauuc

SEQ ID NO: 6746 - RNA, 22 nt, Vaccinia virus
auauauugauuuucguaacaga

SEQ ID NO: 6747 - RNA, 22 nt, Vaccinia virus
gaugacgaugaaaaugauggua

SEQ ID NO: 6748 - RNA, 20 nt, Vaccinia virus
ucauuauuguuauugcuauu

SEQ ID NO: 6749 - RNA, 22 nt, Vaccinia virus
ucuaucaucgggauuuuauuuu

SEQ ID NO: 6750 - RNA, 20 nt, Vaccinia virus
auugaaaacgaaaugaagau

SEQ ID NO: 6751 - RNA, 22 nt, Vaccinia virus
uucaaaaacaguaaaguuguga

SEQ ID NO: 6752 - RNA, 22 nt, Vaccinia virus
caaguuaaauguuuaaaugaua

SEQ ID NO: 6753 - RNA, 22 nt, Vaccinia virus
ugaauugcauacaucggauacc

SEQ ID NO: 6754 - RNA, 22 nt, Vaccinia virus
uccauauauggcaaaucugcaa

SEQ ID NO: 6755 - RNA, 22 nt, Vaccinia virus
cgaaauaaauaaugaauuggaa

SEQ ID NO: 6756 - RNA, 21 nt, Vaccinia virus
aagccgccauugauuacuuug

SEQ ID NO: 6757 - RNA, 22 nt, Vaccinia virus
aauuagaacuagaaacauguuu

SEQ ID NO: 6758 - RNA, 15 nt, Vaccinia virus
ugaauuauuccaauu

SEQ ID NO: 6759 - RNA, 22 nt, Vaccinia virus
ucuuacaaaauaauuauauaga

SEQ ID NO: 6760 - RNA, 21 nt, Vaccinia virus
uauaauagauuacgugcaaga

SEQ ID NO: 6761 - RNA, 22 nt, Vaccinia virus
uuucaugcaacgaauuauuagu

SEQ ID NO: 6762 - RNA, 20 nt, Vaccinia virus
acuaggauuuaaacaagaaa

SEQ ID NO: 6763 - RNA, 22 nt, Vaccinia virus
gaauacuuguacaaucuaagau

SEQ ID NO: 6764 - RNA, 22 nt, Vaccinia virus
ucucgcaaaguuguaucaugga

SEQ ID NO: 6765 - RNA, 22 nt, Vaccinia virus
ggccauuuguagucuuucaaca

SEQ ID NO: 6766 - RNA, 20 nt, Vaccinia virus
uguuagauuuauugacggcu

SEQ ID NO: 6767 - RNA, 22 nt, Vaccinia virus
ugcaauagcugauaauaacgug

SEQ ID NO: 6768 - RNA, 20 nt, Vaccinia virus
guuguugaacgcuggagcau

SEQ ID NO: 6769 - RNA, 22 nt, Vaccinia virus
ugauaaugccuuuauagcgggg

SEQ ID NO: 6770 - RNA, 14 nt, Vaccinia virus
uccaugcaccauca

SEQ ID NO: 6771 - RNA, 22 nt, Vaccinia virus
uacguugggugcacgauuaacg

SEQ ID NO: 6772 - RNA, 22 nt, Vaccinia virus
uaaaaaauucccaagcggaacu

SEQ ID NO: 6773 - RNA, 22 nt, Vaccinia virus
uaucaauacguuagacuucaug

SEQ ID NO: 6774 - RNA, 22 nt, Vaccinia virus
uucagaagauacggaugaugac

SEQ ID NO: 6775 - RNA, 22 nt, Vaccinia virus
acgaaaaaauagcaaccagugu

SEQ ID NO: 6776 - RNA, 20 nt, Vaccinia virus
ucaauauucuguucuaucgu

SEQ ID NO: 6777 - RNA, 22 nt, Vaccinia virus
uuuaaauuagaugaaucgauaa

SEQ ID NO: 6778 - RNA, 22 nt, Vaccinia virus
uguugguaaacccgucgucuau

SEQ ID NO: 6779 - RNA, 22 nt, Vaccinia virus
uuaaaucaugaaguccguauua

SEQ ID NO: 6780 - RNA, 22 nt, Vaccinia virus
uauuguuucucucauguauaau

SEQ ID NO: 6781 - RNA, 22 nt, Vaccinia virus
uuaaaucaugaaguccguauua

SEQ ID NO: 6782 - RNA, 22 nt, Vaccinia virus
uauuguuucucucauguauaau

SEQ ID NO: 6783 - RNA, 22 nt, Vaccinia virus
ugcuaauuacaacauaggagac

SEQ ID NO: 6784 - RNA, 21 nt, Vaccinia virus
ucuaccuggauacagaaagca

SEQ ID NO: 6785 - RNA, 22 nt, Vaccinia virus
acuuacuuauuagguaugaucg

SEQ ID NO: 6786 - RNA, 21 nt, Vaccinia virus
cuugaaugcugaugaacaggu

SEQ ID NO: 6787 - RNA, 22 nt, Vaccinia virus
ucggacacuauuguugugauac

SEQ ID NO: 6788 - RNA, 16 nt, Vaccinia virus
uagaacaucacaucga

SEQ ID NO: 6789 - RNA, 22 nt, Vaccinia virus
ccagacgugacguguauagaac

SEQ ID NO: 6790 - RNA, 21 nt, Vaccinia virus
uacccguguacgcgcaacugg

SEQ ID NO: 6791 - RNA, 22 nt, Vaccinia virus
uacuagcgugaacaacuuacag

SEQ ID NO: 6792 - RNA, 22 nt, Vaccinia virus
cauuaagauugucauguggauu

SEQ ID NO: 6793 - RNA, 22 nt, Vaccinia virus
uaccagguacgacgucacugca

SEQ ID NO: 6794 - RNA, 21 nt, Vaccinia virus
uaugugguauaguacgaggua

SEQ ID NO: 6795 - RNA, 22 nt, Vaccinia virus
ucagacuuuuaacgcgccugaa

SEQ ID NO: 6796 - RNA, 22 nt, Vaccinia virus
uucauggaguuagaaaacgagc

SEQ ID NO: 6797 - RNA, 22 nt, Vaccinia virus
gauuagaugguugggagguauc

SEQ ID NO: 6798 - RNA, 20 nt, Vaccinia virus
gauaucugaaacaaagaauu

SEQ ID NO: 6799 - RNA, 22 nt, Vaccinia virus
uuauaagguacuuuuucucaua

SEQ ID NO: 6800 - RNA, 22 nt, Vaccinia virus
ugaguaagauaguguuuuucaa

SEQ ID NO: 6801 - RNA, 22 nt, Vaccinia virus
ucgcauuuaucuaaccauucaa

SEQ ID NO: 6802 - RNA, 14 nt, Vaccinia virus
uugguaaucagcga

SEQ ID NO: 6803 - RNA, 22 nt, Vaccinia virus
ugcuauucgcaucaaugggcuu

SEQ ID NO: 6804 - RNA, 19 nt, Vaccinia virus
agauccauuaugggaagca

SEQ ID NO: 6805 - RNA, 22 nt, Vaccinia virus
uccauagauggaguaaguaguc

SEQ ID NO: 6806 - RNA, 20 nt, Vaccinia virus
uaaagacucaaaguccggau

SEQ ID NO: 6807 - RNA, 22 nt, Vaccinia virus
ucaauacaucaucuauagauca

SEQ ID NO: 6808 - RNA, 21 nt, Vaccinia virus
uacauagaugaaccaaaugau

SEQ ID NO: 6809 - RNA, 22 nt, Vaccinia virus
ucaauacaucaucuauagauca

SEQ ID NO: 6810 - RNA, 21 nt, Vaccinia virus
uacauagaugaaccaaaugau

SEQ ID NO: 6811 - RNA, 22 nt, Vaccinia virus
ugccaugauagaguuaugcgga

SEQ ID NO: 6812 - RNA, 22 nt, Vaccinia virus
cgucaauguuuacucuccggca

SEQ ID NO: 6813 - RNA, 22 nt, Vaccinia virus
agucauucgaagcgucaauaga

SEQ ID NO: 6814 - RNA, 22 nt, Vaccinia virus
uguuguauauuuaaaugacuuc

SEQ ID NO: 6815 - RNA, 22 nt, Vaccinia virus
uagccgcugagugguaaacaac

SEQ ID NO: 6816 - RNA, 21 nt, Vaccinia virus
uaccaacacccucagccgcug

SEQ ID NO: 6817 - RNA, 22 nt, Vaccinia virus
cggaccuagugguauaucuugu

SEQ ID NO: 6818 - RNA, 22 nt, Vaccinia virus
ucuaaaauaaugucugacuaga

SEQ ID NO: 6819 - RNA, 22 nt, Vaccinia virus
uauguuuauucauaaacgcguc

SEQ ID NO: 6820 - RNA, 22 nt, Vaccinia virus
gcuaaggaguuuaagaaucuca

SEQ ID NO: 6821 - RNA, 22 nt, Vaccinia virus
uuaucagauuuuuugcuuccag

SEQ ID NO: 6822 - RNA, 20 nt, Vaccinia virus
uauacaacagaguuucauaa

SEQ ID NO: 6823 - RNA, 22 nt, Vaccinia virus
ugccgaauacagugcuagggga

SEQ ID NO: 6824 - RNA, 19 nt, Vaccinia virus
uccucuuucguauucguag

SEQ ID NO: 6825 - RNA, 22 nt, Vaccinia virus
uguauaucauaaaauaauguuu

SEQ ID NO: 6826 - RNA, 22 nt, Vaccinia virus
uaauauuuuuugguauauaaau

SEQ ID NO: 6827 - RNA, 22 nt, Vaccinia virus
uguauaucauaaaauaauguuu

SEQ ID NO: 6828 - RNA, 22 nt, Vaccinia virus
uaauauuuuuugguauauaaau

SEQ ID NO: 6829 - RNA, 22 nt, Vaccinia virus
gcuccaggauauacauuguaua

SEQ ID NO: 6830 - RNA, 21 nt, Vaccinia virus
uaguaguguuuuuuucugagu

SEQ ID NO: 6831 - RNA, 22 nt, Vaccinia virus
cauccguucgauauauugcuua

SEQ ID NO: 6832 - RNA, 22 nt, Vaccinia virus
ggauccguaacuaaacaagaug

SEQ ID NO: 6833 - RNA, 22 nt, Vaccinia virus
ggaucggaccauucuccuccug

SEQ ID NO: 6834 - RNA, 22 nt, Vaccinia virus
ggacaccagaguuaccaaucaa

SEQ ID NO: 6835 - RNA, 22 nt, Vaccinia virus
ucaucagcugaaaaacuauguu

SEQ ID NO: 6836 - RNA, 22 nt, Vaccinia virus
guauuccuucggcauuucuuuu

SEQ ID NO: 6837 - RNA, 22 nt, Vaccinia virus
uagccaaugaggguucgaguuc

SEQ ID NO: 6838 - RNA, 21 nt, Vaccinia virus
auucucuucccgcggaugcug

SEQ ID NO: 6839 - RNA, 22 nt, Vaccinia virus
uuccagaugugguuauuucagc

SEQ ID NO: 6840 - RNA, 21 nt, Vaccinia virus
ucuuuaagcccgcuaaagaag

SEQ ID NO: 6841 - RNA, 22 nt, Vaccinia virus
uuagccagagauaucauagccg

SEQ ID NO: 6842 - RNA, 17 nt, Vaccinia virus
gugauuuuccaaccuaa

SEQ ID NO: 6843 - RNA, 22 nt, Vaccinia virus
uauccacgcuagagauauugac

SEQ ID NO: 6844 - RNA, 21 nt, Vaccinia virus
uagaugcucucaugguuauac

SEQ ID NO: 6845 - RNA, 22 nt, Vaccinia virus
uauccacgcuagagauauugac

SEQ ID NO: 6846 - RNA, 21 nt, Vaccinia virus
uagaugcucucaugguuauac

SEQ ID NO: 6847 - RNA, 22 nt, Vaccinia virus
uuauccagggaaauuaaagaag

SEQ ID NO: 6848 - RNA, 16 nt, Vaccinia virus
ucuuuuguauucauag

SEQ ID NO: 6849 - RNA, 22 nt, Vaccinia virus
ucuacccauaaguuaucucuaa

SEQ ID NO: 6850 - RNA, 20 nt, Vaccinia virus
uauggcacucuuauuauaga

SEQ ID NO: 6851 - RNA, 22 nt, Vaccinia virus
uaacgauuuguuuaauuuuuag

SEQ ID NO: 6852 - RNA, 22 nt, Vaccinia virus
auuaauuguaaaugauauuauu

SEQ ID NO: 6853 - RNA, 22 nt, Vaccinia virus
ucgucgguauuuuuuauggcaa

SEQ ID NO: 6854 - RNA, 20 nt, Vaccinia virus
uucuaaaaaaauauuaacga

SEQ ID NO: 6855 - RNA, 22 nt, Vaccinia virus
uguaucuagcgguguuauuaua

SEQ ID NO: 6856 - RNA, 22 nt, Vaccinia virus
aauaauaccguuugauauacca

SEQ ID NO: 6857 - RNA, 22 nt, Vaccinia virus
ugcacauguucgugaucuauga

SEQ ID NO: 6858 - RNA, 22 nt, Vaccinia virus
auaggaucuccgaaucugaaaa

SEQ ID NO: 6859 - RNA, 22 nt, Vaccinia virus
cgcgguuagauauuacgauggu

SEQ ID NO: 6860 - RNA, 22 nt, Vaccinia virus
uauaugaauuagcuaaagauau

SEQ ID NO: 6861 - RNA, 22 nt, Vaccinia virus
uccguauuuugugaaggugaau

SEQ ID NO: 6862 - RNA, 21 nt, Vaccinia virus
ccgauaccgcugauaaggacg

SEQ ID NO: 6863 - RNA, 22 nt, Vaccinia virus
accagaccuaggagcuauucua

SEQ ID NO: 6864 - RNA, 22 nt, Vaccinia virus
gaacuuaggcauggacauacua

SEQ ID NO: 6865 - RNA, 22 nt, Vaccinia virus
uucugcauuauuguaauucgua

SEQ ID NO: 6866 - RNA, 16 nt, Vaccinia virus
aucacuucuaaaagaa

SEQ ID NO: 6867 - RNA, 22 nt, Vaccinia virus
gauagccugauugucuggacca

SEQ ID NO: 6868 - RNA, 18 nt, Vaccinia virus
cggauagagaaauauauu

SEQ ID NO: 6869 - RNA, 22 nt, Vaccinia virus
gaccgucauauuaucucuagcu

SEQ ID NO: 6870 - RNA, 22 nt, Vaccinia virus
gucuuugauaauacgacucuug

SEQ ID NO: 6871 - RNA, 22 nt, Vaccinia virus
aaagggugaguuaauaugcaua

SEQ ID NO: 6872 - RNA, 18 nt, Vaccinia virus
uuuuuucccucguucuuu

SEQ ID NO: 6873 - RNA, 22 nt, Vaccinia virus
ugagggacuugagaggcgcauu

SEQ ID NO: 6874 - RNA, 17 nt, Vaccinia virus
uuuaaaagacagaucau

SEQ ID NO: 6875 - RNA, 22 nt, Vaccinia virus
uggaguagaaacaaaaacagac

SEQ ID NO: 6876 - RNA, 22 nt, Vaccinia virus
ucaacauaugugcuuccucaau

SEQ ID NO: 6877 - RNA, 22 nt, Vaccinia virus
gacaguaugcauucucuuuuau

SEQ ID NO: 6878 - RNA, 22 nt, Vaccinia virus
guaaaacaaugacuacuguaua

SEQ ID NO: 6879 - RNA, 22 nt, Vaccinia virus
gaguuacacacauugauccauu

SEQ ID NO: 6880 - RNA, 22 nt, Vaccinia virus
ugugauggguagugcuguucau

SEQ ID NO: 6881 - RNA, 22 nt, Vaccinia virus
uuaucugauucccuggcacguu

SEQ ID NO: 6882 - RNA, 20 nt, Vaccinia virus
caauugagucagcucuuaac

SEQ ID NO: 6883 - RNA, 22 nt, Vaccinia virus
aauauuuggaucugacccucac

SEQ ID NO: 6884 - RNA, 22 nt, Vaccinia virus
ugaaugcaagacucacgcaucg

SEQ ID NO: 6885 - RNA, 22 nt, Vaccinia virus
uauuauacaaacaguuuaaaaa

SEQ ID NO: 6886 - RNA, 13 nt, Vaccinia virus
agcagugauauau

SEQ ID NO: 6887 - RNA, 22 nt, Vaccinia virus
uaaaugauuaucuacauucugu

SEQ ID NO: 6888 - RNA, 22 nt, Vaccinia virus
auagaggaauauaaaauuaaau

SEQ ID NO: 6889 - RNA, 22 nt, Vaccinia virus
ugguagugauuaauaccuugcc

SEQ ID NO: 6890 - RNA, 22 nt, Vaccinia virus
aguuaguucggauaaguuauuc

SEQ ID NO: 6891 - RNA, 22 nt, Vaccinia virus
aacauaagacagauuaugcugg

SEQ ID NO: 6892 - RNA, 22 nt, Vaccinia virus
ugcguaauaugcggucuaauug

SEQ ID NO: 6893 - RNA, 22 nt, Vaccinia virus
ucaguaauuggaauaagcgucu

SEQ ID NO: 6894 - RNA, 22 nt, Vaccinia virus
uguccguauaccaacaugucug

SEQ ID NO: 6895 - RNA, 22 nt, Vaccinia virus
uuauaaucuagauauuaaagau

SEQ ID NO: 6896 - RNA, 20 nt, Vaccinia virus
gucgcagauaugugguugau

SEQ ID NO: 6897 - RNA, 22 nt, Vaccinia virus
uauagcauugcuguauauuucu

SEQ ID NO: 6898 - RNA, 22 nt, Vaccinia virus
agaauacuaauaaugccaacac

SEQ ID NO: 6899 - RNA, 22 nt, Vaccinia virus
uaguauauucucuaaagaugau

SEQ ID NO: 6900 - RNA, 20 nt, Vaccinia virus
uauucguagagcguuucuag

SEQ ID NO: 6901 - RNA, 22 nt, Vaccinia virus
agcuauaguuaauugaccgugu

SEQ ID NO: 6902 - RNA, 22 nt, Vaccinia virus
uacgcucauuaauaaaauuuuu

SEQ ID NO: 6903 - RNA, 22 nt, Vaccinia virus
uauuuauuuuugugauauugau

SEQ ID NO: 6904 - RNA, 17 nt, Vaccinia virus
uaauauuucggauaaug

SEQ ID NO: 6905 - RNA, 22 nt, Vaccinia virus
uauuuauuuuugugauauugau

SEQ ID NO: 6906 - RNA, 17 nt, Vaccinia virus
uaauauuucggauaaug

SEQ ID NO: 6907 - RNA, 22 nt, Vaccinia virus
gaguucuguaaugaacggauuu

SEQ ID NO: 6908 - RNA, 21 nt, Vaccinia virus
auacugguuuuauuauaauuu

SEQ ID NO: 6909 - RNA, 22 nt, Vaccinia virus
uaccucguacuauaccacauac

SEQ ID NO: 6910 - RNA, 21 nt, Vaccinia virus
gcagugacgucguaccuggua

SEQ ID NO: 6911 - RNA, 22 nt, Vaccinia virus
gaucucacaucagaaauuaaaa

SEQ ID NO: 6912 - RNA, 16 nt, Vaccinia virus
uguuuuuugauggauc

SEQ ID NO: 6913 - RNA, 22 nt, Vaccinia virus
ucgaugaugucgcuauacggua

SEQ ID NO: 6914 - RNA, 22 nt, Vaccinia virus
uugauaaaauuaaugagauugu

SEQ ID NO: 6915 - RNA, 22 nt, Vaccinia virus
uuggugaauccaucucuauguu

SEQ ID NO: 6916 - RNA, 16 nt, Vaccinia virus
cagucagcuggucuaa

SEQ ID NO: 6917 - RNA, 22 nt, Vaccinia virus
ucgucguucaauuuauacggau

SEQ ID NO: 6918 - RNA, 22 nt, Vaccinia virus
caucaugauuagacgacgacaa

SEQ ID NO: 6919 - RNA, 22 nt, Vaccinia virus
ugaguuggcuacuaucuuguac

SEQ ID NO: 6920 - RNA, 22 nt, Vaccinia virus
cauggaaucauagauggccuuu

SEQ ID NO: 6921 - RNA, 22 nt, Vaccinia virus
ucauuaucuacuaucaauuggc

SEQ ID NO: 6922 - RNA, 20 nt, Vaccinia virus
guuuuggguuugggauugag

SEQ ID NO: 6923 - RNA, 22 nt, Vaccinia virus
aaaguuaucugcucccucuuca

SEQ ID NO: 6924 - RNA, 21 nt, Vaccinia virus
aguuucugcuugaguucuucu

SEQ ID NO: 6925 - RNA, 22 nt, Vaccinia virus
uggacgauagagauauuaaucc

SEQ ID NO: 6926 - RNA, 22 nt, Vaccinia virus
uuacagauuucguuuucguagc

SEQ ID NO: 6927 - RNA, 22 nt, Vaccinia virus
uuacuuuccagauaggaaauac

SEQ ID NO: 6928 - RNA, 22 nt, Vaccinia virus
uuucuaaaguauuugaacaugu

SEQ ID NO: 6929 - RNA, 22 nt, Vaccinia virus
ucuauuucaacaaacugguaga

SEQ ID NO: 6930 - RNA, 17 nt, Vaccinia virus
uaacagaaacguuuaga

SEQ ID NO: 6931 - RNA, 22 nt, Vaccinia virus
cgauaaacauuguuauuuagau

SEQ ID NO: 6932 - RNA, 22 nt, Vaccinia virus
ucuacagauaaugcgguuuauc

SEQ ID NO: 6933 - RNA, 22 nt, Vaccinia virus
ucgauuauaaguacacauguag

SEQ ID NO: 6934 - RNA, 20 nt, Vaccinia virus
uauauagaauuuauaaccga

SEQ ID NO: 6935 - RNA, 22 nt, Vaccinia virus
acgauaaguccuuuaaaauaua

SEQ ID NO: 6936 - RNA, 22 nt, Vaccinia virus
uauuaugaaugagagauaccuu

SEQ ID NO: 6937 - RNA, 22 nt, Vaccinia virus
ccuaagaugauaaaaaacuuaa

SEQ ID NO: 6938 - RNA, 22 nt, Vaccinia virus
uuaaauauguuccaucugcaga

SEQ ID NO: 6939 - RNA, 22 nt, Vaccinia virus
gacagaagaauaugaugauuag

SEQ ID NO: 6940 - RNA, 19 nt, Vaccinia virus
uuaucuaacucuuugaguu

SEQ ID NO: 6941 - RNA, 22 nt, Vaccinia virus
ucaaggaaauggaagaaacaga

SEQ ID NO: 6942 - RNA, 20 nt, Vaccinia virus
aauaacauauuuuucuauga

SEQ ID NO: 6943 - RNA, 22 nt, Vaccinia virus
uugggcuuuaucaaguguauua

SEQ ID NO: 6944 - RNA, 22 nt, Vaccinia virus
cuauuauguuuaaagaugacaa

SEQ ID NO: 6945 - RNA, 22 nt, Vaccinia virus
uuagguuuuuggaaaaaacauc

SEQ ID NO: 6946 - RNA, 20 nt, Vaccinia virus
uaacgauucaauaacuaaag

SEQ ID NO: 6947 - RNA, 22 nt, Vaccinia virus
uucauuuuuauuuaugaguguu

SEQ ID NO: 6948 - RNA, 13 nt, Vaccinia virus
agcacuaaaagga

SEQ ID NO: 6949 - RNA, 22 nt, Vaccinia virus
uguagaaaucgauacaguuuuu

SEQ ID NO: 6950 - RNA, 20 nt, Vaccinia virus
uuaaguauguaauuuucaca

SEQ ID NO: 6951 - RNA, 22 nt, Vaccinia virus
uaaguaauuacgagccguugcu

SEQ ID NO: 6952 - RNA, 19 nt, Vaccinia virus
acaugcuguguacuacuau

SEQ ID NO: 6953 - RNA, 22 nt, Vaccinia virus
gcgauagccauguaucuacuaa

SEQ ID NO: 6954 - RNA, 22 nt, Vaccinia virus
uagagauauuauuaauucuggu

SEQ ID NO: 6955 - RNA, 22 nt, Vaccinia virus
aggacacuuugcgcugaauggc

SEQ ID NO: 6956 - RNA, 20 nt, Vaccinia virus
cuauaucauucauugugccu

SEQ ID NO: 6957 - RNA, 22 nt, Vaccinia virus
uaucgcauuuuuugguuucuuu

SEQ ID NO: 6958 - RNA, 21 nt, Vaccinia virus
gauuuagcacguuugggaagc

SEQ ID NO: 6959 - RNA, 22 nt, Vaccinia virus
uaaucuaugccuuuagcuagag

SEQ ID NO: 6960 - RNA, 20 nt, Vaccinia virus
uucuguaucucgacugaugc

SEQ ID NO: 6961 - RNA, 22 nt, Vaccinia virus
ucuaaaauguauaacaaauaca

SEQ ID NO: 6962 - RNA, 20 nt, Vaccinia virus
ucgaugaguauauauuaaga

SEQ ID NO: 6963 - RNA, 22 nt, Vaccinia virus
ugauacuguuacguguccuaau

SEQ ID NO: 6964 - RNA, 22 nt, Vaccinia virus
uagaacacggaucgugucaacc

SEQ ID NO: 6965 - RNA, 22 nt, Vaccinia virus
gaaaaauauuuuacauuuuuag

SEQ ID NO: 6966 - RNA, 20 nt, Vaccinia virus
ugccauguuuaauagcguuc

SEQ ID NO: 6967 - RNA, 22 nt, Vaccinia virus
uguuaacuuagagacugaucca

SEQ ID NO: 6968 - RNA, 22 nt, Vaccinia virus
ucuuuaucauaauucugaguau

SEQ ID NO: 6969 - RNA, 22 nt, Vaccinia virus
cgcacaaaaucauaaaaaauca

SEQ ID NO: 6970 - RNA, 17 nt, Vaccinia virus
uuuugaugauguaggug

SEQ ID NO: 6971 - RNA, 22 nt, Vaccinia virus
uaaacacuauuacccauacauc

SEQ ID NO: 6972 - RNA, 20 nt, Vaccinia virus
uaguaaaaaguauaaaguua

SEQ ID NO: 6973 - RNA, 22 nt, Vaccinia virus
aguaccggaauaaaauaaggug

SEQ ID NO: 6974 - RNA, 20 nt, Vaccinia virus
aucuauuuaguuccuugauu

SEQ ID NO: 6975 - RNA, 22 nt, Vaccinia virus
aguaccgauagguuauugacau

SEQ ID NO: 6976 - RNA, 15 nt, Vaccinia virus
cuauaacuugagacu

SEQ ID NO: 6977 - RNA, 22 nt, Vaccinia virus
uuacuuagucuguacaaaaguu

SEQ ID NO: 6978 - RNA, 22 nt, Vaccinia virus
ucugcggcuauagaaaaguaua

SEQ ID NO: 6979 - RNA, 22 nt, Vaccinia virus
uguaguacuuugaugauuuuuc

SEQ ID NO: 6980 - RNA, 16 nt, Vaccinia virus
gucuuccaaguuggca

SEQ ID NO: 6981 - RNA, 22 nt, Vaccinia virus
gguauauauagauagucauaac

SEQ ID NO: 6982 - RNA, 17 nt, Vaccinia virus
gugcuucuauauuaacc

SEQ ID NO: 6983 - RNA, 22 nt, Vaccinia virus
aguauaaaacauuaaauguccg

SEQ ID NO: 6984 - RNA, 20 nt, Vaccinia virus
uucaguagccaauccuaacu

SEQ ID NO: 6985 - RNA, 22 nt, Vaccinia virus
aguauauauagaaucgccaagu

SEQ ID NO: 6986 - RNA, 21 nt, Vaccinia virus
caggccagauguuaucaaacu

SEQ ID NO: 6987 - RNA, 22 nt, Vaccinia virus
ugaucgcauaugugucuaucca

SEQ ID NO: 6988 - RNA, 21 nt, Vaccinia virus
cucgucuaauaaugaauacag

SEQ ID NO: 6989 - RNA, 22 nt, Vaccinia virus
acuaugcucuaagcggaaucgg

SEQ ID NO: 6990 - RNA, 20 nt, Vaccinia virus
gacuuguguuuggaaggagu

SEQ ID NO: 6991 - RNA, 22 nt, Vaccinia virus
uuagcaauguuaaagugacucc

SEQ ID NO: 6992 - RNA, 22 nt, Vaccinia virus
guuaugaugcauuagccacguu

SEQ ID NO: 6993 - RNA, 22 nt, Vaccinia virus
uugauuuuacucauuggaugca

SEQ ID NO: 6994 - RNA, 21 nt, Vaccinia virus
ugaaucuaugaucaucuccaa

SEQ ID NO: 6995 - RNA, 22 nt, Vaccinia virus
ucuacgguaugguugucuucgu

SEQ ID NO: 6996 - RNA, 22 nt, Vaccinia virus
cacuccuuuccuauacuguaua

SEQ ID NO: 6997 - RNA, 22 nt, Vaccinia virus
aaacuuauauauuauuaauuua

SEQ ID NO: 6998 - RNA, 20 nt, Vaccinia virus
guaaauuauauauauaauuu

SEQ ID NO: 6999 - RNA, 22 nt, Vaccinia virus
aguuucuguuucugagaguaaa

SEQ ID NO: 7000 - RNA, 22 nt, Vaccinia virus
uauuccacagagcacuaauuuc

SEQ ID NO: 7001 - RNA, 22 nt, Vaccinia virus
ugcuacagauauuaucauuagu

SEQ ID NO: 7002 - RNA, 21 nt, Vaccinia virus
ugacgacgauaucgguaccgu

SEQ ID NO: 7003 - RNA, 22 nt, Vaccinia virus
ugcggaauuuuauugugaaucc

SEQ ID NO: 7004 - RNA, 20 nt, Vaccinia virus
acucugauagaugauccuau

SEQ ID NO: 7005 - RNA, 22 nt, Vaccinia virus
uaccguugugucuacaaccgcu

SEQ ID NO: 7006 - RNA, 22 nt, Vaccinia virus
gauucauguuaacacucuacgu

SEQ ID NO: 7007 - RNA, 22 nt, Vaccinia virus
uccugauuaggauaaucaaagu

SEQ ID NO: 7008 - RNA, 22 nt, Vaccinia virus
cggacgaucuuauuaagguagu

SEQ ID NO: 7009 - RNA, 22 nt, Vaccinia virus
uccauuucugaaucaguguuuu

SEQ ID NO: 7010 - RNA, 20 nt, Vaccinia virus
aagcaauucuuuuagacgau

SEQ ID NO: 7011 - RNA, 22 nt, Vaccinia virus
agacuuuacaagaucuacagga

SEQ ID NO: 7012 - RNA, 19 nt, Vaccinia virus
uucuuagcuugugauuuuu

SEQ ID NO: 7013 - RNA, 22 nt, Vaccinia virus
uggcugcccccggaagaaccau

SEQ ID NO: 7014 - RNA, 18 nt, Vaccinia virus
uucaauuccucugguuca

SEQ ID NO: 7015 - RNA, 22 nt, Vaccinia virus
ucccuauuuugaaauugcuaac

SEQ ID NO: 7016 - RNA, 22 nt, Vaccinia virus
ucagccauuuucuuaauuagga

SEQ ID NO: 7017 - RNA, 22 nt, Vaccinia virus
agucuuaccuuacuaucuucca

SEQ ID NO: 7018 - RNA, 16 nt, Vaccinia virus
aggaagagguuacauu

SEQ ID NO: 7019 - RNA, 22 nt, Vaccinia virus
uaacuuuauacuuuuuacuaau

SEQ ID NO: 7020 - RNA, 20 nt, Vaccinia virus
uguauggguaauaguguuua

SEQ ID NO: 7021 - RNA, 22 nt, Vaccinia virus
acggucgcgucuuccguuacaa

SEQ ID NO: 7022 - RNA, 22 nt, Vaccinia virus
ggguaaaugauuauugcgagau

SEQ ID NO: 7023 - RNA, 22 nt, Vaccinia virus
uaguuauagaggcuauacacac

SEQ ID NO: 7024 - RNA, 21 nt, Vaccinia virus
caguggggcaacuguggaugu

SEQ ID NO: 7025 - RNA, 22 nt, Vaccinia virus
uauccauagauggaguaaguag

SEQ ID NO: 7026 - RNA, 22 nt, Vaccinia virus
uaaagacucaaaguccggaugu

SEQ ID NO: 7027 - RNA, 22 nt, Vaccinia virus
gaagaagacaucucaauugauu

SEQ ID NO: 7028 - RNA, 17 nt, Vaccinia virus
ucuuuugauacuuguuc

SEQ ID NO: 7029 - RNA, 22 nt, Vaccinia virus
gauggucgaguauacgauguag

SEQ ID NO: 7030 - RNA, 21 nt, Vaccinia virus
uacaugauaugccggacaauc

SEQ ID NO: 7031 - RNA, 22 nt, Vaccinia virus
uuugugagaccaucgaaggaga

SEQ ID NO: 7032 - RNA, 20 nt, Vaccinia virus
uuuuacgacuccaucagaaa

SEQ ID NO: 7033 - RNA, 22 nt, Vaccinia virus
uuggauguguuaucgauacuaa

SEQ ID NO: 7034 - RNA, 18 nt, Vaccinia virus
uauugaugauauaaacaa

SEQ ID NO: 7035 - RNA, 22 nt, Vaccinia virus
ugggauuuuacuuaauauaaua

SEQ ID NO: 7036 - RNA, 21 nt, Vaccinia virus
uaaauuuuauuagaaaggcca

SEQ ID NO: 7037 - RNA, 22 nt, Vaccinia virus
uggaaauacaccucuccauauu

SEQ ID NO: 7038 - RNA, 16 nt, Vaccinia virus
ucaagaauguagacau

SEQ ID NO: 7039 - RNA, 22 nt, Vaccinia virus
uggccauuaccuacuguccauc

SEQ ID NO: 7040 - RNA, 22 nt, Vaccinia virus
ugcgauagaugguaguauucca

SEQ ID NO: 7041 - RNA, 22 nt, Vaccinia virus
gcgggugcuggagugcuugaua

SEQ ID NO: 7042 - RNA, 22 nt, Vaccinia virus
acagaggaacagcagcaaucgu

SEQ ID NO: 7043 - RNA, 22 nt, Vaccinia virus
ugggguaaaguaaguauuuaua

SEQ ID NO: 7044 - RNA, 20 nt, Vaccinia virus
uaagccugaauuuauuucag

SEQ ID NO: 7045 - RNA, 22 nt, Vaccinia virus
uucguuuuaugagguauuuaga

SEQ ID NO: 7046 - RNA, 20 nt, Vaccinia virus
uaaugauccccauacuagaa

SEQ ID NO: 7047 - RNA, 22 nt, Vaccinia virus
uaacggaucuagucagacauua

SEQ ID NO: 7048 - RNA, 22 nt, Vaccinia virus
aagauauaccacuagguccguu

SEQ ID NO: 7049 - RNA, 22 nt, Vaccinia virus
ccaagaaagcauucagucuaac

SEQ ID NO: 7050 - RNA, 22 nt, Vaccinia virus
uagaccuaucucuuucuuuguu

SEQ ID NO: 7051 - RNA, 22 nt, Vaccinia virus
aguuugauuuuuaguuauuauc

SEQ ID NO: 7052 - RNA, 19 nt, Vaccinia virus
uaguaucugaaaucauauu

SEQ ID NO: 7053 - RNA, 22 nt, Vaccinia virus
agauccgaguuauuccaaacua

SEQ ID NO: 7054 - RNA, 20 nt, Vaccinia virus
uacggauggagucucggucu

SEQ ID NO: 7055 - RNA, 22 nt, Vaccinia virus
ucauuaaacccucgaucaugaa

SEQ ID NO: 7056 - RNA, 22 nt, Vaccinia virus
ugagcuuaguccguuuguccac

SEQ ID NO: 7057 - RNA, 22 nt, Vaccinia virus
aauucaguaaccguagguauuu

SEQ ID NO: 7058 - RNA, 20 nt, Vaccinia virus
caaagaauggugacuguguu

SEQ ID NO: 7059 - RNA, 22 nt, Vaccinia virus
uauugccacaaauuuggaauau

SEQ ID NO: 7060 - RNA, 21 nt, Vaccinia virus
ugauaugauuaaggguacuag

SEQ ID NO: 7061 - RNA, 22 nt, Vaccinia virus
cauguauuaauacccuugauuu

SEQ ID NO: 7062 - RNA, 22 nt, Vaccinia virus
aauuuucacaaacauacacauc

SEQ ID NO: 7063 - RNA, 22 nt, Vaccinia virus
gaguagacauuguugauggauu

SEQ ID NO: 7064 - RNA, 19 nt, Vaccinia virus
uaucaucagcuauuuuuuc

SEQ ID NO: 7065 - RNA, 22 nt, Vaccinia virus
uuuuaaaacuucuguaauagua

SEQ ID NO: 7066 - RNA, 22 nt, Vaccinia virus
cuauuaaacagucucucuccau

SEQ ID NO: 7067 - RNA, 22 nt, Vaccinia virus
uauuccauauuuguuauuuuuu

SEQ ID NO: 7068 - RNA, 22 nt, Vaccinia virus
aaauacauucgauggucuaucu

SEQ ID NO: 7069 - RNA, 22 nt, Vaccinia virus
ucgauaccuagaagaucgugau

SEQ ID NO: 7070 - RNA, 22 nt, Vaccinia virus
cgaacuucuaauuggccgucuc

SEQ ID NO: 7071 - RNA, 22 nt, Vaccinia virus
uuugaaaauguguauaccgccc

SEQ ID NO: 7072 - RNA, 18 nt, Vaccinia virus
uauaauacgucgucuaau

SEQ ID NO: 7073 - RNA, 22 nt, Vaccinia virus
ucuucaguacaucguuuguaaa

SEQ ID NO: 7074 - RNA, 22 nt, Vaccinia virus
uacaaauagcaguguagugcag

SEQ ID NO: 7075 - RNA, 22 nt, Vaccinia virus
ucauucucucgcaucuggacgg

SEQ ID NO: 7076 - RNA, 21 nt, Vaccinia virus
ucucucacacgcgggcgauga

SEQ ID NO: 7077 - RNA, 22 nt, Vaccinia virus
gguuaauauagaagcacguaau

SEQ ID NO: 7078 - RNA, 20 nt, Vaccinia virus
uaugacuaucuauauauacc

SEQ ID NO: 7079 - RNA, 22 nt, Vaccinia virus
cauacgauacauauguaggauc

SEQ ID NO: 7080 - RNA, 22 nt, Vaccinia virus
gguauucuacaauaugaucuuu

SEQ ID NO: 7081 - RNA, 22 nt, Vaccinia virus
gcuuaguaauuuaacuauuuua

SEQ ID NO: 7082 - RNA, 22 nt, Vaccinia virus
auuuuuuauguuaaaucaauua

SEQ ID NO: 7083 - RNA, 22 nt, Vaccinia virus
cgguauugguguucaaggauua

SEQ ID NO: 7084 - RNA, 21 nt, Vaccinia virus
uucucuuaaauuauccauuug

SEQ ID NO: 7085 - RNA, 22 nt, Vaccinia virus
uauauaaugauuuuaaaaauuc

SEQ ID NO: 7086 - RNA, 20 nt, Vaccinia virus
auuuucuaaaucugcauuag

SEQ ID NO: 7087 - RNA, 22 nt, Vaccinia virus
uaucccguacaucuauuuggac

SEQ ID NO: 7088 - RNA, 22 nt, Vaccinia virus
uaccuauaauguaugguccuau

SEQ ID NO: 7089 - RNA, 22 nt, Vaccinia virus
gagucauaacuauuuuaccguu

SEQ ID NO: 7090 - RNA, 19 nt, Vaccinia virus
uagacgaaggaauaaucuc

SEQ ID NO: 7091 - RNA, 22 nt, Vaccinia virus
ugcuccagcguucaacaacgua

SEQ ID NO: 7092 - RNA, 19 nt, Vaccinia virus
guuauuaucagcuauugca

SEQ ID NO: 7093 - RNA, 22 nt, Vaccinia virus
cggucucuacugaaucuacuaa

SEQ ID NO: 7094 - RNA, 20 nt, Vaccinia virus
uuagcuucuacagucuuucg

SEQ ID NO: 7095 - RNA, 22 nt, Vaccinia virus
uaugcauucucuuuuauuguuc

SEQ ID NO: 7096 - RNA, 16 nt, Vaccinia virus
guaaaacaaugacuac

SEQ ID NO: 7097 - RNA, 22 nt, Vaccinia virus
uguggucaaaguaauugucaga

SEQ ID NO: 7098 - RNA, 20 nt, Vaccinia virus
uuauagauauuaauuauuau

SEQ ID NO: 7099 - RNA, 22 nt, Vaccinia virus
gauugguaacaucguuuacaaa

SEQ ID NO: 7100 - RNA, 22 nt, Vaccinia virus
uguaaacaaucugucacugauu

SEQ ID NO: 7101 - RNA, 22 nt, Vaccinia virus
uccugaagguuuuuagacuugu

SEQ ID NO: 7102 - RNA, 17 nt, Vaccinia virus
ccgucccaaaacaugga

SEQ ID NO: 7103 - RNA, 22 nt, Vaccinia virus
uucguugaaccagaggaauuga

SEQ ID NO: 7104 - RNA, 22 nt, Vaccinia virus
uucuuccgggggcagccaacaa

SEQ ID NO: 7105 - RNA, 22 nt, Vaccinia virus
uggcaccuaugccgacugcauc

SEQ ID NO: 7106 - RNA, 22 nt, Vaccinia virus
ugagucgguggaaccguauacc

SEQ ID NO: 7107 - RNA, 22 nt, Vaccinia virus
uauuuguauaauaauuacuuua

SEQ ID NO: 7108 - RNA, 18 nt, Vaccinia virus
agauauuauuaaaucaug

SEQ ID NO: 7109 - RNA, 22 nt, Vaccinia virus
agauuaaaucuccacauugaau

SEQ ID NO: 7110 - RNA, 20 nt, Vaccinia virus
ucgauguuuaauguuccucu

SEQ ID NO: 7111 - RNA, 22 nt, Vaccinia virus
ggauuauauggaacacgauuau

SEQ ID NO: 7112 - RNA, 20 nt, Vaccinia virus
uaguuccugguuccucuucc

SEQ ID NO: 7113 - RNA, 22 nt, Vaccinia virus
uguuuuuuauguuuuguaucga

SEQ ID NO: 7114 - RNA, 21 nt, Vaccinia virus
ucgugacagauacauucuaua

SEQ ID NO: 7115 - RNA, 22 nt, Vaccinia virus
agaguuagaaauagauaaugaa

SEQ ID NO: 7116 - RNA, 22 nt, Vaccinia virus
ucgucauuuaauaauuuuugau

SEQ ID NO: 7117 - RNA, 22 nt, Vaccinia virus
uaguaaagaugcuaguguacca

SEQ ID NO: 7118 - RNA, 20 nt, Vaccinia virus
uuuuugcaucauuuacgcgc

SEQ ID NO: 7119 - RNA, 22 nt, Vaccinia virus
cgauuauaagauguuaaccuuc

SEQ ID NO: 7120 - RNA, 22 nt, Vaccinia virus
accauuauuugauuuuguaaac

SEQ ID NO: 7121 - RNA, 22 nt, Vaccinia virus
ugaguaacuuaacucuuuuguu

SEQ ID NO: 7122 - RNA, 22 nt, Vaccinia virus
aaaguauauucaaaaaaugagu

SEQ ID NO: 7123 - RNA, 22 nt, Vaccinia virus
uuaguaaugauuauaauaggga

SEQ ID NO: 7124 - RNA, 20 nt, Vaccinia virus
uaugauauggcaucuacaaa

SEQ ID NO: 7125 - RNA, 22 nt, Vaccinia virus
uaaauuguuaaugaaaggaaua

SEQ ID NO: 7126 - RNA, 21 nt, Vaccinia virus
uauucauauauagacgaucua

SEQ ID NO: 7127 - RNA, 22 nt, Vaccinia virus
gaaguggauauacauagucgug

SEQ ID NO: 7128 - RNA, 22 nt, Vaccinia virus
uugcuagccucaucuucuauau

SEQ ID NO: 7129 - RNA, 22 nt, Vaccinia virus
aaucuauaauaaaggcucgagu

SEQ ID NO: 7130 - RNA, 22 nt, Vaccinia virus
uauagaaucucagauugaaacu

SEQ ID NO: 7131 - RNA, 22 nt, Vaccinia virus
agacaucgacggaagaguauuc

SEQ ID NO: 7132 - RNA, 18 nt, Vaccinia virus
aaaucuaaacgagaugcu

SEQ ID NO: 7133 - RNA, 22 nt, Vaccinia virus
ccacaaauugcacguuuggaag

SEQ ID NO: 7134 - RNA, 19 nt, Vaccinia virus
ucacugcagcauuuugagg

SEQ ID NO: 7135 - RNA, 22 nt, Vaccinia virus
gcaggacauugaugcucuagac

SEQ ID NO: 7136 - RNA, 18 nt, Vaccinia virus
uacaaauuuuucauccgc

SEQ ID NO: 7137 - RNA, 22 nt, Vaccinia virus
ugaacacuaauuccgcaucauc

SEQ ID NO: 7138 - RNA, 22 nt, Vaccinia virus
aggaguguggaauacaauuguc

SEQ ID NO: 7139 - RNA, 22 nt, Vaccinia virus
gaaaaauuggagacugauguuc

SEQ ID NO: 7140 - RNA, 19 nt, Vaccinia virus
uggaaaacuucauuuuauc

SEQ ID NO: 7141 - RNA, 22 nt, Vaccinia virus
gaaugcuagauuguccagcgug

SEQ ID NO: 7142 - RNA, 22 nt, Vaccinia virus
aagguaaggacucucccgcgau

SEQ ID NO: 7143 - RNA, 22 nt, Vaccinia virus
gaaugcuagauuguccagcgug

SEQ ID NO: 7144 - RNA, 22 nt, Vaccinia virus
aagguaaggacucucccgcgau

SEQ ID NO: 7145 - RNA, 22 nt, Vaccinia virus
ucaacaaaaucuagacgauaug

SEQ ID NO: 7146 - RNA, 18 nt, Vaccinia virus
augucgaauguugaaaga

SEQ ID NO: 7147 - RNA, 22 nt, Vaccinia virus
uaaaagauauacauuaacuggu

SEQ ID NO: 7148 - RNA, 22 nt, Vaccinia virus
ucggcguaagagaauuuucuaa

SEQ ID NO: 7149 - RNA, 22 nt, Vaccinia virus
uauaaaugucuuugucgaugau

SEQ ID NO: 7150 - RNA, 22 nt, Vaccinia virus
uauauccagagauaucuuguaa

SEQ ID NO: 7151 - RNA, 22 nt, Vaccinia virus
ucaaagcaucaaaauaggagau

SEQ ID NO: 7152 - RNA, 20 nt, Vaccinia virus
auaaacuaucggauguggga

SEQ ID NO: 7153 - RNA, 22 nt, Vaccinia virus
uaaauuauauaucaaacaauug

SEQ ID NO: 7154 - RNA, 22 nt, Vaccinia virus
uuccuccgaugaauagccccag

SEQ ID NO: 7155 - RNA, 22 nt, Vaccinia virus
uuaaaaaauguagaauguguug

SEQ ID NO: 7156 - RNA, 20 nt, Vaccinia virus
auaacuuuuaugaaauacga

SEQ ID NO: 7157 - RNA, 22 nt, Vaccinia virus
uaaaucuaaugcaaaauguauc

SEQ ID NO: 7158 - RNA, 22 nt, Vaccinia virus
cacuaaaugcuucucaauacgc

SEQ ID NO: 7159 - RNA, 22 nt, Vaccinia virus
uaacguaugccuuuaauggagu

SEQ ID NO: 7160 - RNA, 19 nt, Vaccinia virus
ucauauaauggauuugcac

SEQ ID NO: 7161 - RNA, 22 nt, Vaccinia virus
uaaggaaaauagacuguccauc

SEQ ID NO: 7162 - RNA, 21 nt, Vaccinia virus
uaagauggauucauuuaagag

SEQ ID NO: 7163 - RNA, 22 nt, Vaccinia virus
aaaagugucauaccggguucuu

SEQ ID NO: 7164 - RNA, 21 nt, Vaccinia virus
acagaucaauggugugauguu

SEQ ID NO: 7165 - RNA, 22 nt, Vaccinia virus
caacgucgauuugaugaacaca

SEQ ID NO: 7166 - RNA, 22 nt, Vaccinia virus
ugcuucuaugagauugaucaug

SEQ ID NO: 7167 - RNA, 22 nt, Vaccinia virus
uacuuuugugaugucggaaauc

SEQ ID NO: 7168 - RNA, 17 nt, Vaccinia virus
ugacaggcagaacacgu

SEQ ID NO: 7169 - RNA, 22 nt, Vaccinia virus
uacagcacgugguaacuauuaa

SEQ ID NO: 7170 - RNA, 22 nt, Vaccinia virus
auugggucauuccaugggagcu

SEQ ID NO: 7171 - RNA, 22 nt, Vaccinia virus
uacaacucaucaauucauacgc

SEQ ID NO: 7172 - RNA, 13 nt, Vaccinia virus
cacguaauugagc

SEQ ID NO: 7173 - RNA, 22 nt, Vaccinia virus
gaacagaucagaucucgauaaa

SEQ ID NO: 7174 - RNA, 17 nt, Vaccinia virus
ucuuuucugggaauauu

SEQ ID NO: 7175 - RNA, 22 nt, Vaccinia virus
uuaguacgaguuuauccuucaa

SEQ ID NO: 7176 - RNA, 22 nt, Vaccinia virus
aaaugacguauaacuuguauga

SEQ ID NO: 7177 - RNA, 22 nt, Vaccinia virus
uacccucccuaguaauugcucu

SEQ ID NO: 7178 - RNA, 22 nt, Vaccinia virus
auauuguugauuacugccgagc

SEQ ID NO: 7179 - RNA, 22 nt, Vaccinia virus
acacuagcauuguucaaugugc

SEQ ID NO: 7180 - RNA, 21 nt, Vaccinia virus
uaaggaguugaaauagcucgu

SEQ ID NO: 7181 - RNA, 22 nt, Vaccinia virus
ggagaauguuacaccggcuuua

SEQ ID NO: 7182 - RNA, 18 nt, Vaccinia virus
uacuccgauugacguauc

SEQ ID NO: 7183 - RNA, 22 nt, Vaccinia virus
ccaguuauggggacgcgcucau

SEQ ID NO: 7184 - RNA, 21 nt, Vaccinia virus
ugaggaguguauuccuugagg

SEQ ID NO: 7185 - RNA, 22 nt, Vaccinia virus
uauucagaaaaaaauacaugcu

SEQ ID NO: 7186 - RNA, 21 nt, Vaccinia virus
uuaauuuuaaucugauaaagu

SEQ ID NO: 7187 - RNA, 22 nt, Vaccinia virus
uuaugagugcuugguauaagga

SEQ ID NO: 7188 - RNA, 22 nt, Vaccinia virus
cauuauucuuuuagcugcuaaa

SEQ ID NO: 7189 - RNA, 22 nt, Vaccinia virus
gaauuauguauuagaauaguuu

SEQ ID NO: 7190 - RNA, 21 nt, Vaccinia virus
acccuguucccguuacaucuc

SEQ ID NO: 7191 - RNA, 22 nt, Vaccinia virus
uauucuaccauggcuccguuua

SEQ ID NO: 7192 - RNA, 20 nt, Vaccinia virus
agauggauucauccuuaaau

SEQ ID NO: 7193 - RNA, 22 nt, Vaccinia virus
uggcggcuagaauggcauaauc

SEQ ID NO: 7194 - RNA, 22 nt, Vaccinia virus
uggcugcuauuucggcugccag

SEQ ID NO: 7195 - RNA, 22 nt, Vaccinia virus
uuacuauuauuuauaacugaug

SEQ ID NO: 7196 - RNA, 22 nt, Vaccinia virus
uagaauuaauuaucgauaguaa

SEQ ID NO: 7197 - RNA, 22 nt, Vaccinia virus
uucuaucaaagauguuauacac

SEQ ID NO: 7198 - RNA, 14 nt, Vaccinia virus
uaugacugaugaaa

SEQ ID NO: 7199 - RNA, 22 nt, Vaccinia virus
uucauaauguuaagcauauccu

SEQ ID NO: 7200 - RNA, 17 nt, Vaccinia virus
ugugucauacuuguuag

SEQ ID NO: 7201 - RNA, 22 nt, Vaccinia virus
ucuguuuuauuaaccgaacgag

SEQ ID NO: 7202 - RNA, 19 nt, Vaccinia virus
uuggauuaauaauucaugg

SEQ ID NO: 7203 - RNA, 22 nt, Vaccinia virus
cgcacuaucgauuugauacuuu

SEQ ID NO: 7204 - RNA, 21 nt, Vaccinia virus
agcuaucgucauugaucaucg

SEQ ID NO: 7205 - RNA, 22 nt, Vaccinia virus
ucaugaguaccuaguucauaug

SEQ ID NO: 7206 - RNA, 21 nt, Vaccinia virus
augaaggagguuuucuaauau

SEQ ID NO: 7207 - RNA, 22 nt, Vaccinia virus
ucgagcuuuguuaccaauggau

SEQ ID NO: 7208 - RNA, 19 nt, Vaccinia virus
uuggaaccacacgagcuga

SEQ ID NO: 7209 - RNA, 22 nt, Vaccinia virus
gcauauuacgcagcaagcauaa

SEQ ID NO: 7210 - RNA, 22 nt, Vaccinia virus
uauguuuguucauugucgugug

SEQ ID NO: 7211 - RNA, 22 nt, Vaccinia virus
uguagaagagggaagagaagga

SEQ ID NO: 7212 - RNA, 22 nt, Vaccinia virus
uaagaaccuuaaugaucuggau

SEQ ID NO: 7213 - RNA, 22 nt, Vaccinia virus
uaguaucugaaaucauauucau

SEQ ID NO: 7214 - RNA, 15 nt, Vaccinia virus
ugauaauauauagua

SEQ ID NO: 7215 - RNA, 22 nt, Vaccinia virus
uugugagaccaucgaagagaga

SEQ ID NO: 7216 - RNA, 20 nt, Vaccinia virus
uuuuuacgacuccaucagaa

SEQ ID NO: 7217 - RNA, 22 nt, Vaccinia virus
uugugagaccaucgaagagaga

SEQ ID NO: 7218 - RNA, 20 nt, Vaccinia virus
uuuuuacgacuccaucagaa

SEQ ID NO: 7219 - RNA, 22 nt, Vaccinia virus
uugugagaccaucgaagagaga

SEQ ID NO: 7220 - RNA, 20 nt, Vaccinia virus
uuuuuacgacuccaucagaa

SEQ ID NO: 7221 - RNA, 22 nt, Vaccinia virus
uugugagaccaucgaagagaga

SEQ ID NO: 7222 - RNA, 20 nt, Vaccinia virus
uuuuuacgacuccaucagaa

SEQ ID NO: 7223 - RNA, 22 nt, Vaccinia virus
uugugagaccaucgaagagaga

SEQ ID NO: 7224 - RNA, 20 nt, Vaccinia virus
uuuuuacgacuccaucagaa

SEQ ID NO: 7225 - RNA, 22 nt, Vaccinia virus
uugugagaccaucgaagagaga

SEQ ID NO: 7226 - RNA, 20 nt, Vaccinia virus
uuuuuacgacuccaucagaa

SEQ ID NO: 7227 - RNA, 22 nt, Vaccinia virus
uugugagaccaucgaagagaga

SEQ ID NO: 7228 - RNA, 20 nt, Vaccinia virus
uuuuuacgacuccaucagaa

SEQ ID NO: 7229 - RNA, 22 nt, Vaccinia virus
uugugagaccaucgaagagaga

SEQ ID NO: 7230 - RNA, 20 nt, Vaccinia virus
uuuuuacgacuccaucagaa

SEQ ID NO: 7231 - RNA, 22 nt, Vaccinia virus
uugugagaccaucgaagagaga

SEQ ID NO: 7232 - RNA, 20 nt, Vaccinia virus
uuuuuacgacuccaucagaa

SEQ ID NO: 7233 - RNA, 22 nt, Vaccinia virus
uugugagaccaucgaagagaga

SEQ ID NO: 7234 - RNA, 20 nt, Vaccinia virus
uuuuuacgacuccaucagaa

SEQ ID NO: 7235 - RNA, 22 nt, Vaccinia virus
uugugagaccaucgaagagaga

SEQ ID NO: 7236 - RNA, 20 nt, Vaccinia virus
uuuuuacgacuccaucagaa

SEQ ID NO: 7237 - RNA, 22 nt, Vaccinia virus
uugugagaccaucgaagagaga

SEQ ID NO: 7238 - RNA, 20 nt, Vaccinia virus
uuuuuacgacuccaucagaa

SEQ ID NO: 7239 - RNA, 22 nt, Vaccinia virus
uugugagaccaucgaagagaga

SEQ ID NO: 7240 - RNA, 20 nt, Vaccinia virus
uuuuuacgacuccaucagaa

SEQ ID NO: 7241 - RNA, 22 nt, Vaccinia virus
uugugagaccaucgaagagaga

SEQ ID NO: 7242 - RNA, 20 nt, Vaccinia virus
uuuuuacgacuccaucagaa

SEQ ID NO: 7243 - RNA, 22 nt, Vaccinia virus
acguaguaaucgucguagggag

SEQ ID NO: 7244 - RNA, 19 nt, Vaccinia virus
caacgauuuaaucauaggu

SEQ ID NO: 7245 - RNA, 22 nt, Vaccinia virus
aagacgucacagguacccaagu

SEQ ID NO: 7246 - RNA, 22 nt, Vaccinia virus
uuugguuuaauuauuuauuugg

SEQ ID NO: 7247 - RNA, 22 nt, Vaccinia virus
aagacuagacauuuaccauggg

SEQ ID NO: 7248 - RNA, 20 nt, Vaccinia virus
caaacauacaucuauaaauu

SEQ ID NO: 7249 - RNA, 22 nt, Vaccinia virus
uugauaccacgucacgugaauu

SEQ ID NO: 7250 - RNA, 22 nt, Vaccinia virus
auguuacacuuaacgcuggaaa

SEQ ID NO: 7251 - RNA, 22 nt, Vaccinia virus
gagauagauacgugauuaauac

SEQ ID NO: 7252 - RNA, 12 nt, Vaccinia virus
cguaaccgaauc

SEQ ID NO: 7253 - RNA, 22 nt, Vaccinia virus
uacaaguucauaaaaauaauaa

SEQ ID NO: 7254 - RNA, 22 nt, Vaccinia virus
uaguagaaacaugaaaccagua

SEQ ID NO: 7255 - RNA, 22 nt, Vaccinia virus
ugaugaauaugaugaagauagc

SEQ ID NO: 7256 - RNA, 20 nt, Vaccinia virus
ccaauauucaauguauaaau

SEQ ID NO: 7257 - RNA, 22 nt, Vaccinia virus
uauauugugagauuuuuuccau

SEQ ID NO: 7258 - RNA, 22 nt, Vaccinia virus
ugguuuaaguacucuaguauaa

SEQ ID NO: 7259 - RNA, 22 nt, Vaccinia virus
ugcgaauuacuuauaccgauag

SEQ ID NO: 7260 - RNA, 20 nt, Vaccinia virus
ugcuaugguaucuaggaaau

SEQ ID NO: 7261 - RNA, 22 nt, Vaccinia virus
uaauuaguuuuuuucucucaau

SEQ ID NO: 7262 - RNA, 22 nt, Vaccinia virus
ugauggaaaaaugacuaauuuu

SEQ ID NO: 7263 - RNA, 22 nt, Vaccinia virus
uaggauacggaguauccggaga

SEQ ID NO: 7264 - RNA, 21 nt, Vaccinia virus
uccguguggucucggaacaua

SEQ ID NO: 7265 - RNA, 22 nt, Vaccinia virus
ucguuuuaacgugucauagaua

SEQ ID NO: 7266 - RNA, 22 nt, Vaccinia virus
uaugcuaucaucgaucauguua

SEQ ID NO: 7267 - RNA, 22 nt, Vaccinia virus
gaguauuuaugacuaacuuuuc

SEQ ID NO: 7268 - RNA, 20 nt, Vaccinia virus
gaaggucuacauaaaccauc

SEQ ID NO: 7269 - RNA, 22 nt, Vaccinia virus
gaccgucauauuaucucuagcu

SEQ ID NO: 7270 - RNA, 22 nt, Vaccinia virus
gucuuugauaauacgacucuug

SEQ ID NO: 7271 - RNA, 22 nt, Vaccinia virus
gauaaacuuccguuuaaaaaug

SEQ ID NO: 7272 - RNA, 17 nt, Vaccinia virus
gacggaauguuuuacuc

SEQ ID NO: 7273 - RNA, 22 nt, Vaccinia virus
ggauaucuauuuuuuugucaug

SEQ ID NO: 7274 - RNA, 22 nt, Vaccinia virus
gggacgaagaaacguaauaucc

SEQ ID NO: 7275 - RNA, 22 nt, Vaccinia virus
uguaguaagugucgauuguaau

SEQ ID NO: 7276 - RNA, 21 nt, Vaccinia virus
uaggacagauacuacuauuug

SEQ ID NO: 7277 - RNA, 22 nt, Vaccinia virus
uuugucucauauguucuucuau

SEQ ID NO: 7278 - RNA, 22 nt, Vaccinia virus
uauuaagauuugucaaguugga

SEQ ID NO: 7279 - RNA, 22 nt, Vaccinia virus
cauaauauccuuauccgacuuu

SEQ ID NO: 7280 - RNA, 20 nt, Vaccinia virus
ggugguauaauuuuauuuug

SEQ ID NO: 7281 - RNA, 22 nt, Vaccinia virus
uguccaauuugagguaccuaua

SEQ ID NO: 7282 - RNA, 14 nt, Vaccinia virus
ccauauauuuggca

SEQ ID NO: 7283 - RNA, 22 nt, Vaccinia virus
acucaucguuccauaguuuuuu

SEQ ID NO: 7284 - RNA, 18 nt, Vaccinia virus
aucuuuggagugcuuggu

SEQ ID NO: 7285 - RNA, 22 nt, Vaccinia virus
uugauaaaaauacuaauaucua

SEQ ID NO: 7286 - RNA, 17 nt, Vaccinia virus
uauuuauuuuacuccgu

SEQ ID NO: 7287 - RNA, 22 nt, Vaccinia virus
acuaaaaauaaacauugauuaa

SEQ ID NO: 7288 - RNA, 14 nt, Vaccinia virus
aauggauguugugu

SEQ ID NO: 7289 - RNA, 22 nt, Vaccinia virus
uauauaaugauuuuaaaaauuc

SEQ ID NO: 7290 - RNA, 20 nt, Vaccinia virus
aauuuucuaaaucugcauua

SEQ ID NO: 7291 - RNA, 22 nt, Vaccinia virus
uuucaucagucauacugagcca

SEQ ID NO: 7292 - RNA, 22 nt, Vaccinia virus
guguauaacaucuuugauagaa

SEQ ID NO: 7293 - RNA, 22 nt, Vaccinia virus
caucuucuucaauaccaucaua

SEQ ID NO: 7294 - RNA, 18 nt, Vaccinia virus
acuaucuauuauagauug

SEQ ID NO: 7295 - RNA, 22 nt, Vaccinia virus
uucuuagaguuuucgaauagag

SEQ ID NO: 7296 - RNA, 21 nt, Vaccinia virus
ucuauuacguucacucguugc

SEQ ID NO: 7297 - RNA, 22 nt, Vaccinia virus
gcugcuuggguuaauaugccga

SEQ ID NO: 7298 - RNA, 22 nt, Vaccinia virus
cuagauguaauccagcaguggc

SEQ ID NO: 7299 - RNA, 22 nt, Vaccinia virus
uuuuuugucuauaauauccauu

SEQ ID NO: 7300 - RNA, 21 nt, Vaccinia virus
guacauagauuauccaauuga

SEQ ID NO: 7301 - RNA, 22 nt, Vaccinia virus
aauuuauuuaucaauuuuaaag

SEQ ID NO: 7302 - RNA, 20 nt, Vaccinia virus
uauuguugcucgaauauuuu

SEQ ID NO: 7303 - RNA, 22 nt, Vaccinia virus
cguuaccaagaaaaauaauaau

SEQ ID NO: 7304 - RNA, 20 nt, Vaccinia virus
uugugauuuuguuauugucg

SEQ ID NO: 7305 - RNA, 22 nt, Vaccinia virus
aauuccuuauccuguuccugaa

SEQ ID NO: 7306 - RNA, 15 nt, Vaccinia virus
ucaucagauuaaguu

SEQ ID NO: 7307 - RNA, 22 nt, Vaccinia virus
uguuccgguguuaauccacuau

SEQ ID NO: 7308 - RNA, 22 nt, Vaccinia virus
uagcggcugauaacacagcauc

SEQ ID NO: 7309 - RNA, 22 nt, Vaccinia virus
uaucguuaaaaauuugaacgau

SEQ ID NO: 7310 - RNA, 22 nt, Vaccinia virus
ucuguuuucacaaaauuauagu

SEQ ID NO: 7311 - RNA, 22 nt, Vaccinia virus
uuuuuauucucuuaauuauaac

SEQ ID NO: 7312 - RNA, 20 nt, Vaccinia virus
auuauaacggauuaucucgc

SEQ ID NO: 7313 - RNA, 22 nt, Vaccinia virus
uuuugugauuuuucuuccuaaa

SEQ ID NO: 7314 - RNA, 22 nt, Vaccinia virus
uagauagaauauucauuaguuc

SEQ ID NO: 7315 - RNA, 22 nt, Vaccinia virus
augauaauaaugaauugguguu

SEQ ID NO: 7316 - RNA, 20 nt, Vaccinia virus
uacacaauuucuauuauuac

SEQ ID NO: 7317 - RNA, 22 nt, Vaccinia virus
aacgaaauucuccagaagaugu

SEQ ID NO: 7318 - RNA, 21 nt, Vaccinia virus
uaggacauuugauuucgucgg

SEQ ID NO: 7319 - RNA, 22 nt, Vaccinia virus
agaaaccguuagaucuauuaua

SEQ ID NO: 7320 - RNA, 22 nt, Vaccinia virus
cgguauccauugaacaagaauu

SEQ ID NO: 7321 - RNA, 22 nt, Vaccinia virus
auucguuuauuaauaucgggaa

SEQ ID NO: 7322 - RNA, 19 nt, Vaccinia virus
auugcccggaagcggagcu

SEQ ID NO: 7323 - RNA, 22 nt, Vaccinia virus
aaauugcauaccuauaggaaua

SEQ ID NO: 7324 - RNA, 22 nt, Vaccinia virus
uguaaucacugcgauuguauua

SEQ ID NO: 7325 - RNA, 22 nt, Vaccinia virus
uagauauaauaaacaaucucua

SEQ ID NO: 7326 - RNA, 21 nt, Vaccinia virus
uagaauccgguucagauguca

SEQ ID NO: 7327 - RNA, 22 nt, Vaccinia virus
augauuuuguagaugccauauc

SEQ ID NO: 7328 - RNA, 22 nt, Vaccinia virus
uauucaugucccuauuauaauc

SEQ ID NO: 7329 - RNA, 22 nt, Vaccinia virus
augauauacaggcaauuaugga

SEQ ID NO: 7330 - RNA, 22 nt, Vaccinia virus
guuuuuaaaguauaguagauca

SEQ ID NO: 7331 - RNA, 22 nt, Vaccinia virus
uauggguaaaguuuuugucccc

SEQ ID NO: 7332 - RNA, 17 nt, Vaccinia virus
aagaauuuauuucuaaa

SEQ ID NO: 7333 - RNA, 22 nt, Vaccinia virus
uaaacauaagggaaugucauuu

SEQ ID NO: 7334 - RNA, 20 nt, Vaccinia virus
aagcauucuaccguuguuaa

SEQ ID NO: 7335 - RNA, 22 nt, Vaccinia virus
auuguuauauaguguaacacga

SEQ ID NO: 7336 - RNA, 16 nt, Vaccinia virus
ucguugugcuacaaau

SEQ ID NO: 7337 - RNA, 22 nt, Vaccinia virus
uauacaguauaggaaaggagug

SEQ ID NO: 7338 - RNA, 21 nt, Vaccinia virus
cgaagacaaccauaccguaga

SEQ ID NO: 7339 - RNA, 22 nt, Vaccinia virus
aaauucuauugaguauauucua

SEQ ID NO: 7340 - RNA, 20 nt, Vaccinia virus
gaaagcauauauagaaugag

SEQ ID NO: 7341 - RNA, 22 nt, Vaccinia virus
aacuucucuaaaugagucuacu

SEQ ID NO: 7342 - RNA, 21 nt, Vaccinia virus
ucaucgaagaagauaccauau

SEQ ID NO: 7343 - RNA, 22 nt, Vaccinia virus
uaaauggguguugccaaugauu

SEQ ID NO: 7344 - RNA, 15 nt, Vaccinia virus
augucuccccauaga

SEQ ID NO: 7345 - RNA, 22 nt, Vaccinia virus
aauaaauuuauucucucuauga

SEQ ID NO: 7346 - RNA, 20 nt, Vaccinia virus
ucccgagagauaauauagag

SEQ ID NO: 7347 - RNA, 22 nt, Vaccinia virus
uaaauuuuagaaauaacauuag

SEQ ID NO: 7348 - RNA, 22 nt, Vaccinia virus
ugaugucguuauucugaaacag

SEQ ID NO: 7349 - RNA, 22 nt, Vaccinia virus
aaaaaauaauaauaucauuuac

SEQ ID NO: 7350 - RNA, 20 nt, Vaccinia virus
auuaaacaaaucguuauuau

SEQ ID NO: 7351 - RNA, 22 nt, Vaccinia virus
aaaacaaugaacucggaugucc

SEQ ID NO: 7352 - RNA, 22 nt, Vaccinia virus
aaaaugucuaguguaucuagau

SEQ ID NO: 7353 - RNA, 20 nt, Vaccinia virus
ucgagugauauauuagaucu

SEQ ID NO: 7354 - RNA, 22 nt, Vaccinia virus
aaaaugguacaaaaggaaaguu

SEQ ID NO: 7355 - RNA, 21 nt, Vaccinia virus
uguaaagucaccguaccuacu

SEQ ID NO: 7356 - RNA, 22 nt, Vaccinia virus
aaauuauuaauaauauauuugg

SEQ ID NO: 7357 - RNA, 17 nt, Vaccinia virus
ugucuuaucaauugaag

SEQ ID NO: 7358 - RNA, 22 nt, Vaccinia virus
aacuaauaauauauuguuaauu

SEQ ID NO: 7359 - RNA, 22 nt, Vaccinia virus
aaaauaacaauacaauauugaa

SEQ ID NO: 7360 - RNA, 22 nt, Vaccinia virus
aacuaauaauauauuguuaauu

SEQ ID NO: 7361 - RNA, 22 nt, Vaccinia virus
aaaauaacaauacaauauugaa

SEQ ID NO: 7362 - RNA, 22 nt, Vaccinia virus
aacaugauauuuucuguaccau

SEQ ID NO: 7363 - RNA, 21 nt, Vaccinia virus
uauagaaaugcgaaucuauau

SEQ ID NO: 7364 - RNA, 22 nt, Vaccinia virus
aacauauuuaauucagaucuaa

SEQ ID NO: 7365 - RNA, 21 nt, Vaccinia virus
uagaaugaauacaacgaauac

SEQ ID NO: 7366 - RNA, 22 nt, Vaccinia virus
accuucuggaaauaauuaucac

SEQ ID NO: 7367 - RNA, 22 nt, Vaccinia virus
uggaauuaaaggacuagaugaa

SEQ ID NO: 7368 - RNA, 22 nt, Vaccinia virus
uaaguaugaugucuauguacgg

SEQ ID NO: 7369 - RNA, 18 nt, Vaccinia virus
uguaaaggaaucauucgg

SEQ ID NO: 7370 - RNA, 22 nt, Vaccinia virus
aauaacaguaucauuuaaacau

SEQ ID NO: 7371 - RNA, 21 nt, Vaccinia virus
uaaucucacaacuuuacuguu

SEQ ID NO: 7372 - RNA, 22 nt, Vaccinia virus
aauaguuuuacguuauuaauca

SEQ ID NO: 7373 - RNA, 20 nt, Vaccinia virus
ucgcuagauaacgcuaaugu

SEQ ID NO: 7374 - RNA, 22 nt, Vaccinia virus
uaauauaugaggcuguaauaca

SEQ ID NO: 7375 - RNA, 20 nt, Vaccinia virus
gagauauugauuuauucuga

SEQ ID NO: 7376 - RNA, 22 nt, Vaccinia virus
uaauucugcuauuucugggaua

SEQ ID NO: 7377 - RNA, 22 nt, Vaccinia virus
ucugccaguauaacacaaauag

SEQ ID NO: 7378 - RNA, 22 nt, Vaccinia virus
accuaaaaguuuuaaaucuuug

SEQ ID NO: 7379 - RNA, 22 nt, Vaccinia virus
aguuuauacauucuuuaaauuu

SEQ ID NO: 7380 - RNA, 22 nt, Vaccinia virus
uacaggauauagaagaugaggc

SEQ ID NO: 7381 - RNA, 21 nt, Vaccinia virus
gaucacgacuauguauaucca

SEQ ID NO: 7382 - RNA, 22 nt, Vaccinia virus
cauuaaaaucuacgaacuaccc

SEQ ID NO: 7383 - RNA, 22 nt, Vaccinia virus
uuuacacgcagaucuuaaaccc

SEQ ID NO: 7384 - RNA, 22 nt, Vaccinia virus
uacauauuccuggagauacacu

SEQ ID NO: 7385 - RNA, 20 nt, Vaccinia virus
gguauuuauucauaauaaga

SEQ ID NO: 7386 - RNA, 22 nt, Vaccinia virus
uacaccaaagauauucuuuagg

SEQ ID NO: 7387 - RNA, 19 nt, Vaccinia virus
gcuaauguaucuaggggga

SEQ ID NO: 7388 - RNA, 22 nt, Vaccinia virus
uacaaaauguugauaauccuug

SEQ ID NO: 7389 - RNA, 22 nt, Vaccinia virus
uccgaccccaucauuucaacag

SEQ ID NO: 7390 - RNA, 22 nt, Vaccinia virus
acugaaauaaccgcgugauuau

SEQ ID NO: 7391 - RNA, 22 nt, Vaccinia virus
uaauucuacacggcaugguuuc

SEQ ID NO: 7392 - RNA, 22 nt, Vaccinia virus
uacuuacggcuacggcauuaga

SEQ ID NO: 7393 - RNA, 22 nt, Vaccinia virus
uaauuaagaaaauggcugaaca

SEQ ID NO: 7394 - RNA, 22 nt, Vaccinia virus
uaguagaaauauuuaagcacuu

SEQ ID NO: 7395 - RNA, 20 nt, Vaccinia virus
agaaaacacuccuucuaaga

SEQ ID NO: 7396 - RNA, 22 nt, Vaccinia virus
aggugauuggaaugggauaaau

SEQ ID NO: 7397 - RNA, 18 nt, Vaccinia virus
uaucauauccuucacgcu

SEQ ID NO: 7398 - RNA, 22 nt, Vaccinia virus
agaaucguuaaauaccggauac

SEQ ID NO: 7399 - RNA, 21 nt, Vaccinia virus
uguguuuaguaaguuggaugu

SEQ ID NO: 7400 - RNA, 22 nt, Vaccinia virus
auggcguuuaaauauagacauu

SEQ ID NO: 7401 - RNA, 21 nt, Vaccinia virus
uaucuaaugugcuuagcuccc

SEQ ID NO: 7402 - RNA, 22 nt, Vaccinia virus
auuaguucaacuucauacuaau

SEQ ID NO: 7403 - RNA, 20 nt, Vaccinia virus
aacaauguugauguuuaucu

SEQ ID NO: 7404 - RNA, 22 nt, Vaccinia virus
auauuaugauauguuuacuaaa

SEQ ID NO: 7405 - RNA, 19 nt, Vaccinia virus
uguaacguaacucauaagu

SEQ ID NO: 7406 - RNA, 22 nt, Vaccinia virus
auaacauguaacgagauuuuau

SEQ ID NO: 7407 - RNA, 12 nt, Vaccinia virus
ucucuauguaau

SEQ ID NO: 7408 - RNA, 22 nt, Vaccinia virus
uauaaagugcacguuuacauau

SEQ ID NO: 7409 - RNA, 19 nt, Vaccinia virus
aacgugacuauugagacga

SEQ ID NO: 7410 - RNA, 22 nt, Vaccinia virus
auaauucguucuguauuauucu

SEQ ID NO: 7411 - RNA, 20 nt, Vaccinia virus
guggccgcuugacggucaag

SEQ ID NO: 7412 - RNA, 22 nt, Vaccinia virus
auaauauuaaaagauggauaua

SEQ ID NO: 7413 - RNA, 13 nt, Vaccinia virus
uacuauuuuuuac

SEQ ID NO: 7414 - RNA, 22 nt, Vaccinia virus
auaguauuauuaacggaaacag

SEQ ID NO: 7415 - RNA, 20 nt, Vaccinia virus
uuuuuauaauuuaucggugu

SEQ ID NO: 7416 - RNA, 22 nt, Vaccinia virus
auauaaugauauauauuuucac

SEQ ID NO: 7417 - RNA, 20 nt, Vaccinia virus
aauguuuuuguuuaaccacu

SEQ ID NO: 7418 - RNA, 22 nt, Vaccinia virus
auaucgauauaaaaaaaauaac

SEQ ID NO: 7419 - RNA, 20 nt, Vaccinia virus
guaguauuuuauucccagau

SEQ ID NO: 7420 - RNA, 22 nt, Vaccinia virus
auccaauuguuugauauauaau

SEQ ID NO: 7421 - RNA, 19 nt, Vaccinia virus
uauguauuucauuguucau

SEQ ID NO: 7422 - RNA, 22 nt, Vaccinia virus
aucaucuaucugucuagauuau

SEQ ID NO: 7423 - RNA, 20 nt, Vaccinia virus
aucaggaauccaacaaauau

SEQ ID NO: 7424 - RNA, 22 nt, Vaccinia virus
uauccauacuguauguugcuac

SEQ ID NO: 7425 - RNA, 21 nt, Vaccinia virus
uauccaauaauaguuuaaaca

SEQ ID NO: 7426 - RNA, 22 nt, Vaccinia virus
auguuauagauguggauguacg

SEQ ID NO: 7427 - RNA, 22 nt, Vaccinia virus
uacuuuuauaauuauagaucag

SEQ ID NO: 7428 - RNA, 22 nt, Vaccinia virus
auguuuaucuucuuccagcgua

SEQ ID NO: 7429 - RNA, 14 nt, Vaccinia virus
gcgugauaguuuau

SEQ ID NO: 7430 - RNA, 22 nt, Vaccinia virus
uauuugucauuuuauauuuguu

SEQ ID NO: 7431 - RNA, 20 nt, Vaccinia virus
uguaucgaauacgacguaga

SEQ ID NO: 7432 - RNA, 22 nt, Vaccinia virus
uuuauauaaauucuucaaaguu

SEQ ID NO: 7433 - RNA, 21 nt, Vaccinia virus
cuacauagaucaauguaucgc

SEQ ID NO: 7434 - RNA, 22 nt, Vaccinia virus
uaaaauaauaguuuugcuagau

SEQ ID NO: 7435 - RNA, 22 nt, Vaccinia virus
ucugggagagcuacaaagucac

SEQ ID NO: 7436 - RNA, 22 nt, Vaccinia virus
auucaucaauaaugacgcauau

SEQ ID NO: 7437 - RNA, 20 nt, Vaccinia virus
auuaauaguuuugauauuag

SEQ ID NO: 7438 - RNA, 22 nt, Vaccinia virus
uauuuuauagcuaugcgauugg

SEQ ID NO: 7439 - RNA, 20 nt, Vaccinia virus
ugccgcaagcuauuaggcga

SEQ ID NO: 7440 - RNA, 22 nt, Vaccinia virus
uauuuuacuagaguuacuaaga

SEQ ID NO: 7441 - RNA, 21 nt, Vaccinia virus
caaucuaugugauucuaaagg

SEQ ID NO: 7442 - RNA, 22 nt, Vaccinia virus
ucaccgcauugguguuccgauu

SEQ ID NO: 7443 - RNA, 22 nt, Vaccinia virus
uauggaauaguguuagauaaau

SEQ ID NO: 7444 - RNA, 22 nt, Vaccinia virus
ucgguauuauauuauuaggauc

SEQ ID NO: 7445 - RNA, 21 nt, Vaccinia virus
uaucauaauauuaaucaucca

SEQ ID NO: 7446 - RNA, 22 nt, Vaccinia virus
ucaaugcacucuugaagauuuu

SEQ ID NO: 7447 - RNA, 20 nt, Vaccinia virus
gcggauucucaaaguauuua

SEQ ID NO: 7448 - RNA, 22 nt, Vaccinia virus
ucuauugccaaauuuuugaaaa

SEQ ID NO: 7449 - RNA, 21 nt, Vaccinia virus
ugcuuaaaucuauauaaugua

SEQ ID NO: 7450 - RNA, 22 nt, Vaccinia virus
cuucuuuagucaauggauauuc

SEQ ID NO: 7451 - RNA, 21 nt, Vaccinia virus
ucaucaucauuggacagaauc

SEQ ID NO: 7452 - RNA, 22 nt, Vaccinia virus
ucaucauuguguaaacuaaaua

SEQ ID NO: 7453 - RNA, 20 nt, Vaccinia virus
uuuaguaaggacauuggaua

SEQ ID NO: 7454 - RNA, 22 nt, Vaccinia virus
ucauccuuuagagaaaagucgc

SEQ ID NO: 7455 - RNA, 21 nt, Vaccinia virus
uuuucaucucuuagacgagaa

SEQ ID NO: 7456 - RNA, 22 nt, Vaccinia virus
ucacagauauuuccaugucauu

SEQ ID NO: 7457 - RNA, 17 nt, Vaccinia virus
uggagaaucucaaagcg

SEQ ID NO: 7458 - RNA, 22 nt, Vaccinia virus
ucacauuguauauaguuuauaa

SEQ ID NO: 7459 - RNA, 22 nt, Vaccinia virus
auugguuguggaucuucuacaa

SEQ ID NO: 7460 - RNA, 22 nt, Vaccinia virus
cagcaauagaucggaugauuua

SEQ ID NO: 7461 - RNA, 18 nt, Vaccinia virus
uaguauaucaaagaucuu

SEQ ID NO: 7462 - RNA, 22 nt, Vaccinia virus
caugccuaguaauagucucuuu

SEQ ID NO: 7463 - RNA, 22 nt, Vaccinia virus
gcagacuagaaauaacaggcua

SEQ ID NO: 7464 - RNA, 22 nt, Vaccinia virus
ucaucagacaugauauuacugg

SEQ ID NO: 7465 - RNA, 21 nt, Vaccinia virus
uaagguggaaucuccuuaaua

SEQ ID NO: 7466 - RNA, 22 nt, Vaccinia virus
uggauuggagaucacuaacuca

SEQ ID NO: 7467 - RNA, 22 nt, Vaccinia virus
guauugcgaucuucaauaauag

SEQ ID NO: 7468 - RNA, 22 nt, Vaccinia virus
uccauugccuucaguuaucaau

SEQ ID NO: 7469 - RNA, 20 nt, Vaccinia virus
gagaugaacacugcaaucag

SEQ ID NO: 7470 - RNA, 22 nt, Vaccinia virus
ucccguuuaauaucgcauuugu

SEQ ID NO: 7471 - RNA, 19 nt, Vaccinia virus
gugugguauguucacgaua

SEQ ID NO: 7472 - RNA, 22 nt, Vaccinia virus
ccauggucauagagaacggaau

SEQ ID NO: 7473 - RNA, 22 nt, Vaccinia virus
ugucaucuauaaaauccaagag

SEQ ID NO: 7474 - RNA, 22 nt, Vaccinia virus
ccaugacacuaaguugcaacgg

SEQ ID NO: 7475 - RNA, 20 nt, Vaccinia virus
uucguugcgaagaaaaaaau

SEQ ID NO: 7476 - RNA, 22 nt, Vaccinia virus
cgcuccauauaauaucugcguu

SEQ ID NO: 7477 - RNA, 22 nt, Vaccinia virus
augcauuaauauugggacauac

SEQ ID NO: 7478 - RNA, 22 nt, Vaccinia virus
ccucuuaucaagauauucuccc

SEQ ID NO: 7479 - RNA, 20 nt, Vaccinia virus
gcggaguagguauaucugcc

SEQ ID NO: 7480 - RNA, 22 nt, Vaccinia virus
ucguuaucgguuuucuacacuc

SEQ ID NO: 7481 - RNA, 21 nt, Vaccinia virus
ugugcgagacacaaauaauaa

SEQ ID NO: 7482 - RNA, 22 nt, Vaccinia virus
cggcuaauugcuucggccaaca

SEQ ID NO: 7483 - RNA, 21 nt, Vaccinia virus
uuaaugucguacaaagguauc

SEQ ID NO: 7484 - RNA, 22 nt, Vaccinia virus
ucgguccacguguauuacuaua

SEQ ID NO: 7485 - RNA, 21 nt, Vaccinia virus
uauaugguauaaagauauaaa

SEQ ID NO: 7486 - RNA, 22 nt, Vaccinia virus
cuuuccugccgaauuuagagau

SEQ ID NO: 7487 - RNA, 21 nt, Vaccinia virus
ucuucauuagugggaaucaau

SEQ ID NO: 7488 - RNA, 22 nt, Vaccinia virus
ucucuuucucucuucgaugguc

SEQ ID NO: 7489 - RNA, 18 nt, Vaccinia virus
cucuuucugauggagucg

SEQ ID NO: 7490 - RNA, 22 nt, Vaccinia virus
ucucuuucucucuucgaugguc

SEQ ID NO: 7491 - RNA, 18 nt, Vaccinia virus
cucuuucugauggagucg

SEQ ID NO: 7492 - RNA, 22 nt, Vaccinia virus
ucucuuucucucuucgaugguc

SEQ ID NO: 7493 - RNA, 18 nt, Vaccinia virus
cucuuucugauggagucg

SEQ ID NO: 7494 - RNA, 22 nt, Vaccinia virus
ucucuuucucucuucgaugguc

SEQ ID NO: 7495 - RNA, 18 nt, Vaccinia virus
cucuuucugauggagucg

SEQ ID NO: 7496 - RNA, 22 nt, Vaccinia virus
ucucuuucucucuucgaugguc

SEQ ID NO: 7497 - RNA, 18 nt, Vaccinia virus
cucuuucugauggagucg

SEQ ID NO: 7498 - RNA, 22 nt, Vaccinia virus
ucucuuucucucuucgaugguc

SEQ ID NO: 7499 - RNA, 18 nt, Vaccinia virus
cucuuucugauggagucg

SEQ ID NO: 7500 - RNA, 22 nt, Vaccinia virus
ucucuuucucucuucgaugguc

SEQ ID NO: 7501 - RNA, 18 nt, Vaccinia virus
cucuuucugauggagucg

SEQ ID NO: 7502 - RNA, 22 nt, Vaccinia virus
ucucuuucucucuucgaugguc

SEQ ID NO: 7503 - RNA, 18 nt, Vaccinia virus
cucuuucugauggagucg

SEQ ID NO: 7504 - RNA, 22 nt, Vaccinia virus
ucucuuucucucuucgaugguc

SEQ ID NO: 7505 - RNA, 18 nt, Vaccinia virus
cucuuucugauggagucg

SEQ ID NO: 7506 - RNA, 22 nt, Vaccinia virus
ucucuuucucucuucgaugguc

SEQ ID NO: 7507 - RNA, 18 nt, Vaccinia virus
cucuuucugauggagucg

SEQ ID NO: 7508 - RNA, 22 nt, Vaccinia virus
ucucuuucucucuucgaugguc

SEQ ID NO: 7509 - RNA, 18 nt, Vaccinia virus
cucuuucugauggagucg

SEQ ID NO: 7510 - RNA, 22 nt, Vaccinia virus
ucucuuucucucuucgaugguc

SEQ ID NO: 7511 - RNA, 18 nt, Vaccinia virus
cucuuucugauggagucg

SEQ ID NO: 7512 - RNA, 22 nt, Vaccinia virus
ucucuuucucucuucgaugguc

SEQ ID NO: 7513 - RNA, 18 nt, Vaccinia virus
cucuuucugauggagucg

SEQ ID NO: 7514 - RNA, 22 nt, Vaccinia virus
ucucuuucucucuucgaugguc

SEQ ID NO: 7515 - RNA, 18 nt, Vaccinia virus
cucuuucugauggagucg

SEQ ID NO: 7516 - RNA, 22 nt, Vaccinia virus
ucucuuucucucuucgaugguc

SEQ ID NO: 7517 - RNA, 18 nt, Vaccinia virus
cucuuucugauggagucg

SEQ ID NO: 7518 - RNA, 22 nt, Vaccinia virus
ucucuuucucucuucgaugguc

SEQ ID NO: 7519 - RNA, 18 nt, Vaccinia virus
cucuuucugauggagucg

SEQ ID NO: 7520 - RNA, 22 nt, Vaccinia virus
ucucuuucucucuucgaugguc

SEQ ID NO: 7521 - RNA, 18 nt, Vaccinia virus
cucuuucugauggagucg

SEQ ID NO: 7522 - RNA, 22 nt, Vaccinia virus
ucucuuucucucuucgaugguc

SEQ ID NO: 7523 - RNA, 18 nt, Vaccinia virus
cucuuucugauggagucg

SEQ ID NO: 7524 - RNA, 22 nt, Vaccinia virus
ucucuuucucucuucgaugguc

SEQ ID NO: 7525 - RNA, 18 nt, Vaccinia virus
cucuuucugauggagucg

SEQ ID NO: 7526 - RNA, 22 nt, Vaccinia virus
ucucuuucucucuucgaugguc

SEQ ID NO: 7527 - RNA, 18 nt, Vaccinia virus
cucuuucugauggagucg

SEQ ID NO: 7528 - RNA, 22 nt, Vaccinia virus
ucucuuucucucuucgaugguc

SEQ ID NO: 7529 - RNA, 18 nt, Vaccinia virus
cucuuucugauggagucg

SEQ ID NO: 7530 - RNA, 22 nt, Vaccinia virus
ucuaccguuuuguucuuggaug

SEQ ID NO: 7531 - RNA, 20 nt, Vaccinia virus
uaaaguccgcacuacuguua

SEQ ID NO: 7532 - RNA, 22 nt, Vaccinia virus
uaauuguuucauauguuuuaau

SEQ ID NO: 7533 - RNA, 22 nt, Vaccinia virus
caaauauaugcaaaauaauauc

SEQ ID NO: 7534 - RNA, 22 nt, Vaccinia virus
ucuauuaagcgauuucauuuau

SEQ ID NO: 7535 - RNA, 21 nt, Vaccinia virus
uauuaguucauuguuuuaaca

SEQ ID NO: 7536 - RNA, 22 nt, Vaccinia virus
cucucuucccucuaucauguuc

SEQ ID NO: 7537 - RNA, 22 nt, Vaccinia virus
uguccacgaugauaaauaucua

SEQ ID NO: 7538 - RNA, 22 nt, Vaccinia virus
ucucuuucuccuucgauggucu

SEQ ID NO: 7539 - RNA, 18 nt, Vaccinia virus
cucuuucugauggagucg

SEQ ID NO: 7540 - RNA, 22 nt, Vaccinia virus
ucucuuucuccuucgauggucu

SEQ ID NO: 7541 - RNA, 18 nt, Vaccinia virus
cucuuucugauggagucg

SEQ ID NO: 7542 - RNA, 22 nt, Vaccinia virus
ucucuuucuccuucgauggucu

SEQ ID NO: 7543 - RNA, 18 nt, Vaccinia virus
cucuuucugauggagucg

SEQ ID NO: 7544 - RNA, 22 nt, Vaccinia virus
cuuauagauagauaguacauaa

SEQ ID NO: 7545 - RNA, 20 nt, Vaccinia virus
ucuaccuaucucuuuauuau

SEQ ID NO: 7546 - RNA, 22 nt, Vaccinia virus
ucuuucauccuuugacaucauu

SEQ ID NO: 7547 - RNA, 22 nt, Vaccinia virus
accgauucacauacguuacuaa

SEQ ID NO: 7548 - RNA, 22 nt, Vaccinia virus
gauuuuaucaauauuagauugu

SEQ ID NO: 7549 - RNA, 18 nt, Vaccinia virus
uauugcaaugacggauau

SEQ ID NO: 7550 - RNA, 22 nt, Vaccinia virus
uguagcuguuggaaccggcugu

SEQ ID NO: 7551 - RNA, 21 nt, Vaccinia virus
uaguugguuguagcgguugga

SEQ ID NO: 7552 - RNA, 22 nt, Vaccinia virus
uguguuuagaaaaucuaauaac

SEQ ID NO: 7553 - RNA, 22 nt, Vaccinia virus
uaauagaaaaugcaucuaaaca

SEQ ID NO: 7554 - RNA, 22 nt, Vaccinia virus
ggauauuucaucuccguaaaua

SEQ ID NO: 7555 - RNA, 22 nt, Vaccinia virus
uauuuauagaagauaucacaua

SEQ ID NO: 7556 - RNA, 22 nt, Vaccinia virus
guauuacccggauacguggaua

SEQ ID NO: 7557 - RNA, 18 nt, Vaccinia virus
uccauuaucaguaauagc

SEQ ID NO: 7558 - RNA, 22 nt, Vaccinia virus
guauauagauacuauagaagug

SEQ ID NO: 7559 - RNA, 20 nt, Vaccinia virus
uuauucauggaauauauggg

SEQ ID NO: 7560 - RNA, 22 nt, Vaccinia virus
ugaugcacuuacuguauuaaug

SEQ ID NO: 7561 - RNA, 21 nt, Vaccinia virus
uaugugacggugucuguauga

SEQ ID NO: 7562 - RNA, 22 nt, Vaccinia virus
ugucauucucguuuuuauagag

SEQ ID NO: 7563 - RNA, 22 nt, Vaccinia virus
uaaauauuaauuaaugaaauaa

SEQ ID NO: 7564 - RNA, 22 nt, Vaccinia virus
gguagagauggaaguugaucca

SEQ ID NO: 7565 - RNA, 18 nt, Vaccinia virus
cauucuuaucuacaauau

SEQ ID NO: 7566 - RNA, 22 nt, Vaccinia virus
gucccuuaauaggcaguaggcu

SEQ ID NO: 7567 - RNA, 17 nt, Vaccinia virus
guaaucgucguagggag

SEQ ID NO: 7568 - RNA, 22 nt, Vaccinia virus
gauagaagcgauggauacuuuc

SEQ ID NO: 7569 - RNA, 22 nt, Vaccinia virus
aguuaccgcggcuaguccuaug

SEQ ID NO: 7570 - RNA, 22 nt, Vaccinia virus
gagguaaauaggcuaaagacua

SEQ ID NO: 7571 - RNA, 20 nt, Vaccinia virus
aacgaucgcuagagaucugc

SEQ ID NO: 7572 - RNA, 22 nt, Vaccinia virus
gucaauguuuuaaaauauaugg

SEQ ID NO: 7573 - RNA, 22 nt, Vaccinia virus
uguauaaaaacuugugugaaau

SEQ ID NO: 7574 - RNA, 22 nt, Vaccinia virus
gucaauguuuuaaaauauaugg

SEQ ID NO: 7575 - RNA, 22 nt, Vaccinia virus
uguauaaaaacuugugugaaau

SEQ ID NO: 7576 - RNA, 22 nt, Vaccinia virus
gacggggaugaugaaccuaugg

SEQ ID NO: 7577 - RNA, 20 nt, Vaccinia virus
ugguaaaguaaaucauagug

SEQ ID NO: 7578 - RNA, 22 nt, Vaccinia virus
gaaucguuggagauagugucuu

SEQ ID NO: 7579 - RNA, 22 nt, Vaccinia virus
auuugaaauaucuuaugaugac

SEQ ID NO: 7580 - RNA, 22 nt, Vaccinia virus
gagcguaugaaauugucgauau

SEQ ID NO: 7581 - RNA, 20 nt, Vaccinia virus
ccgaaaaugaauugcgugac

SEQ ID NO: 7582 - RNA, 22 nt, Vaccinia virus
gagaggcguaaaaucccuuagg

SEQ ID NO: 7583 - RNA, 22 nt, Vaccinia virus
uaaaggaugaucccgguucaac

SEQ ID NO: 7584 - RNA, 22 nt, Vaccinia virus
gaauaaaauaaaacagggauuc

SEQ ID NO: 7585 - RNA, 20 nt, Vaccinia virus
cagaaacuugcaaagaagac

SEQ ID NO: 7586 - RNA, 22 nt, Vaccinia virus
acuuauuuuuuacuaccuaaau

SEQ ID NO: 7587 - RNA, 22 nt, Vaccinia virus
uccggaaugaagagccgcaaaa

SEQ ID NO: 7588 - RNA, 22 nt, Vaccinia virus
gaguauguuuuuguagaugaga

SEQ ID NO: 7589 - RNA, 22 nt, Vaccinia virus
ucauuagaaguauaaaaaaaua

SEQ ID NO: 7590 - RNA, 22 nt, Vaccinia virus
gauauaaaaguccuugauccau

SEQ ID NO: 7591 - RNA, 22 nt, Vaccinia virus
aucuccauuuaagacuagacgc

SEQ ID NO: 7592 - RNA, 22 nt, Vaccinia virus
gcaccguuuccaaaaucaaucg

SEQ ID NO: 7593 - RNA, 20 nt, Vaccinia virus
uguuggaaucgucuaaaaau

SEQ ID NO: 7594 - RNA, 22 nt, Vaccinia virus
gguggaggaauuuauagaugcu

SEQ ID NO: 7595 - RNA, 18 nt, Vaccinia virus
ugguguucuacauccaau

SEQ ID NO: 7596 - RNA, 22 nt, Vaccinia virus
uggccucucuguuaacguaaug

SEQ ID NO: 7597 - RNA, 22 nt, Vaccinia virus
ucucguuccauaggacgaggaa

SEQ ID NO: 7598 - RNA, 22 nt, Vaccinia virus
uggaauauggcucaaaaaaacu

SEQ ID NO: 7599 - RNA, 22 nt, Vaccinia virus
gguguguugucuaacguauugg

SEQ ID NO: 7600 - RNA, 22 nt, Vaccinia virus
uacguagaagaaaauaaugaag

SEQ ID NO: 7601 - RNA, 22 nt, Vaccinia virus
guuuaugacaccauaggcauug

SEQ ID NO: 7602 - RNA, 22 nt, Vaccinia virus
ugccgugaguguaauaauuuga

SEQ ID NO: 7603 - RNA, 22 nt, Vaccinia virus
guaaacggauggguaaaaaagg

SEQ ID NO: 7604 - RNA, 20 nt, Vaccinia virus
cuuuuuaucgauagaggaag

SEQ ID NO: 7605 - RNA, 22 nt, Vaccinia virus
guauuuuauagaguaaaacaaa

SEQ ID NO: 7606 - RNA, 16 nt, Vaccinia virus
uucuauauaaaucuau

SEQ ID NO: 7607 - RNA, 22 nt, Vaccinia virus
ugucaucaugaacggcggacau

SEQ ID NO: 7608 - RNA, 19 nt, Vaccinia virus
cccauguuuucagguaaaa

SEQ ID NO: 7609 - RNA, 22 nt, Vaccinia virus
ucgaguguuacaugauggguau

SEQ ID NO: 7610 - RNA, 21 nt, Vaccinia virus
ucucuuaugucauacuaaaaa

SEQ ID NO: 7611 - RNA, 22 nt, Vaccinia virus
uucccauacuaauugguuacua

SEQ ID NO: 7612 - RNA, 22 nt, Vaccinia virus
auuuuuaacaguuugagguuuu

SEQ ID NO: 7613 - RNA, 22 nt, Vaccinia virus
uaauaaaacagaguuagugucu

SEQ ID NO: 7614 - RNA, 20 nt, Vaccinia virus
caauauuaaacaguuuauua

SEQ ID NO: 7615 - RNA, 22 nt, Vaccinia virus
ugauucaguaaacgaauaauuu

SEQ ID NO: 7616 - RNA, 20 nt, Vaccinia virus
ggcuuaacuauaugaguuuu

SEQ ID NO: 7617 - RNA, 22 nt, Vaccinia virus
ucaggaauccaaagagcuauaa

SEQ ID NO: 7618 - RNA, 14 nt, Vaccinia virus
ucguuuccuguauu

SEQ ID NO: 7619 - RNA, 22 nt, Vaccinia virus
uucauccgauaacauguuaauu

SEQ ID NO: 7620 - RNA, 16 nt, Vaccinia virus
uaauauuucgaugaua

SEQ ID NO: 7621 - RNA, 22 nt, Vaccinia virus
uugucguuguaugaguaugauc

SEQ ID NO: 7622 - RNA, 15 nt, Vaccinia virus
uauccguuugauauu

SEQ ID NO: 7623 - RNA, 22 nt, Vaccinia virus
uaaugauacacacuacacuguc

SEQ ID NO: 7624 - RNA, 20 nt, Vaccinia virus
caaaguaguugacacguuua

SEQ ID NO: 7625 - RNA, 22 nt, Vaccinia virus
ucucuuucucucuucgaugguc

SEQ ID NO: 7626 - RNA, 18 nt, Vaccinia virus
cucuuucugauggagucg

SEQ ID NO: 7627 - RNA, 22 nt, Vaccinia virus
ucucuuucucucuucgaugguc

SEQ ID NO: 7628 - RNA, 18 nt, Vaccinia virus
cucuuucugauggagucg

SEQ ID NO: 7629 - RNA, 22 nt, Vaccinia virus
uauugcgcaucgauaucuuuau

SEQ ID NO: 7630 - RNA, 22 nt, Vaccinia virus
aauuuaucaauaaaugugagaa

SEQ ID NO: 7631 - RNA, 22 nt, Vaccinia virus
uauuucuguggauuaauagauu

SEQ ID NO: 7632 - RNA, 21 nt, Vaccinia virus
ucauuaaucaucucuaaucuc

SEQ ID NO: 7633 - RNA, 22 nt, Vaccinia virus
uaguuucuaauaugaggaaaau

SEQ ID NO: 7634 - RNA, 15 nt, Vaccinia virus
cucuauacauuacuc

SEQ ID NO: 7635 - RNA, 22 nt, Vaccinia virus
uagacaccuuuucaauguuuaa

SEQ ID NO: 7636 - RNA, 22 nt, Vaccinia virus
agcuuugauaaagccuuccucg

SEQ ID NO: 7637 - RNA, 22 nt, Vaccinia virus
uagucaaauuuguaguacuugg

SEQ ID NO: 7638 - RNA, 22 nt, Vaccinia virus
agaguuuaauuuguuguaucuu

SEQ ID NO: 7639 - RNA, 22 nt, Vaccinia virus
uauuuuguuuauucuguucuuu

SEQ ID NO: 7640 - RNA, 21 nt, Vaccinia virus
gaacaucgaaagacaggacua

SEQ ID NO: 7641 - RNA, 22 nt, Vaccinia virus
uaucaaggaggaugaaaccguu

SEQ ID NO: 7642 - RNA, 22 nt, Vaccinia virus
ugguagaaucgucacucuacag

SEQ ID NO: 7643 - RNA, 22 nt, Vaccinia virus
uaaugugcauaguagaauccuu

SEQ ID NO: 7644 - RNA, 19 nt, Vaccinia virus
ucuauuaguaaaaauaauu

SEQ ID NO: 7645 - RNA, 22 nt, Vaccinia virus
uaagugcaaguacggauauaaa

SEQ ID NO: 7646 - RNA, 21 nt, Vaccinia virus
ucaucaucuacuugcucucca

SEQ ID NO: 7647 - RNA, 22 nt, Vaccinia virus
uaaaaacugauauaacuccggu

SEQ ID NO: 7648 - RNA, 20 nt, Vaccinia virus
gggcaauguuuuaguuuaua

SEQ ID NO: 7649 - RNA, 22 nt, Vaccinia virus
uagaggugauguaaucguuagu

SEQ ID NO: 7650 - RNA, 20 nt, Vaccinia virus
cuuaguuucaucauuuaaug

SEQ ID NO: 7651 - RNA, 22 nt, Vaccinia virus
uagauguaaugguaacgauaac

SEQ ID NO: 7652 - RNA, 21 nt, Vaccinia virus
gcugcccaccucauacauaua

SEQ ID NO: 7653 - RNA, 22 nt, Vaccinia virus
uagaauuggacacucuggcagc

SEQ ID NO: 7654 - RNA, 20 nt, Vaccinia virus
cacuuguacuacacaacauc

SEQ ID NO: 7655 - RNA, 22 nt, Vaccinia virus
uaugggcauuuguauuuugaua

SEQ ID NO: 7656 - RNA, 14 nt, Vaccinia virus
uaaaauauaauccg

SEQ ID NO: 7657 - RNA, 22 nt, Vaccinia virus
uauaauguuaccaauccguuug

SEQ ID NO: 7658 - RNA, 19 nt, Vaccinia virus
ucauuggaaggaaaaacua

SEQ ID NO: 7659 - RNA, 22 nt, Vaccinia virus
uauauuaucaugaauaaaaaua

SEQ ID NO: 7660 - RNA, 18 nt, Vaccinia virus
uucuuuuuugaaacgcca

SEQ ID NO: 7661 - RNA, 22 nt, Vaccinia virus
ucccaaacauucucugcuuaaa

SEQ ID NO: 7662 - RNA, 22 nt, Vaccinia virus
uuuuuauuuuucguuuuacagu

SEQ ID NO: 7663 - RNA, 22 nt, Vaccinia virus
uaugguaucuucuucgaugagg

SEQ ID NO: 7664 - RNA, 16 nt, Vaccinia virus
ucauuuagagaaguuu

SEQ ID NO: 7665 - RNA, 22 nt, Vaccinia virus
ucauucuauauaugcuuuccuu

SEQ ID NO: 7666 - RNA, 22 nt, Vaccinia virus
gauagaauauacucaauagaau

SEQ ID NO: 7667 - RNA, 22 nt, Vaccinia virus
ucuuagcgcaucagauguugau

SEQ ID NO: 7668 - RNA, 20 nt, Vaccinia virus
cauuuuuaugacguugguuc

SEQ ID NO: 7669 - RNA, 22 nt, Vaccinia virus
ucuuuuguauucgguaguucaa

SEQ ID NO: 7670 - RNA, 22 nt, Vaccinia virus
auccaugcauagaucggcaaag

SEQ ID NO: 7671 - RNA, 22 nt, Vaccinia virus
ucccaauauuaaugcauuuauu

SEQ ID NO: 7672 - RNA, 22 nt, Vaccinia virus
uaaacgcagauauuauauggag

SEQ ID NO: 7673 - RNA, 22 nt, Vaccinia virus
ucaaauuugcauaauuaacgau

SEQ ID NO: 7674 - RNA, 19 nt, Vaccinia virus
uaacuucuguugauuuaua

SEQ ID NO: 7675 - RNA, 22 nt, Vaccinia virus
uccgacgcaauagugaaacaug

SEQ ID NO: 7676 - RNA, 22 nt, Vaccinia virus
uaaaaccauagaaucaguugau

SEQ ID NO: 7677 - RNA, 22 nt, Vaccinia virus
uccgcuugggaauuuuuuaacg

SEQ ID NO: 7678 - RNA, 20 nt, Vaccinia virus
uuaaucgugcacccaacgua

SEQ ID NO: 7679 - RNA, 22 nt, Vaccinia virus
ucuauauuaucucucgggaaca

SEQ ID NO: 7680 - RNA, 16 nt, Vaccinia virus
gagaauaaauuuauug

SEQ ID NO: 7681 - RNA, 22 nt, Vaccinia virus
uccauuacgauucuaguuucaa

SEQ ID NO: 7682 - RNA, 20 nt, Vaccinia virus
uugaauccucguaguuuguu

SEQ ID NO: 7683 - RNA, 22 nt, Vaccinia virus
uguuucaaaguaacuuauauca

SEQ ID NO: 7684 - RNA, 22 nt, Vaccinia virus
ucugauauacucacaaauuuuc

SEQ ID NO: 7685 - RNA, 22 nt, Vaccinia virus
ucuuuccauaguacauaguugu

SEQ ID NO: 7686 - RNA, 20 nt, Vaccinia virus
uaaauacagaguguggaacg

SEQ ID NO: 7687 - RNA, 22 nt, Vaccinia virus
ucuccucguuugucaaucaugu

SEQ ID NO: 7688 - RNA, 21 nt, Vaccinia virus
uaagguaggcaaauguuuaua

SEQ ID NO: 7689 - RNA, 22 nt, Vaccinia virus
ugaaugagauacuaacacauuu

SEQ ID NO: 7690 - RNA, 20 nt, Vaccinia virus
aauguuacauuauuuuauug

SEQ ID NO: 7691 - RNA, 22 nt, Vaccinia virus
ugcaagaauucaccauguuggu

SEQ ID NO: 7692 - RNA, 21 nt, Vaccinia virus
aggauccuuacaacaccaauc

SEQ ID NO: 7693 - RNA, 22 nt, Vaccinia virus
uuucuuugguaaugaaauuauu

SEQ ID NO: 7694 - RNA, 22 nt, Vaccinia virus
ucuucuuuaucuaccagagauu

SEQ ID NO: 7695 - RNA, 22 nt, Vaccinia virus
uuuguuuagaugcauuuucuau

SEQ ID NO: 7696 - RNA, 15 nt, Vaccinia virus
gauuuucuaaacaca

SEQ ID NO: 7697 - RNA, 22 nt, Vaccinia virus
uuaugaucauuuuuaacagcaa

SEQ ID NO: 7698 - RNA, 20 nt, Vaccinia virus
uguuauuuuuauauuauuua

SEQ ID NO: 7699 - RNA, 22 nt, Vaccinia virus
uuauuuucauuuuuuaaguaua

SEQ ID NO: 7700 - RNA, 20 nt, Vaccinia virus
uauaaaaacuaaaaaaauua

SEQ ID NO: 7701 - RNA, 22 nt, Vaccinia virus
uuucuauaaucauuuuagcuau

SEQ ID NO: 7702 - RNA, 19 nt, Vaccinia virus
uaguacauuuuccagauua

SEQ ID NO: 7703 - RNA, 22 nt, Vaccinia virus
uucuccagagaauaaggcauuu

SEQ ID NO: 7704 - RNA, 20 nt, Vaccinia virus
aguagauuuaucgagagugg

SEQ ID NO: 7705 - RNA, 22 nt, Vaccinia virus
uuucacacaaguuuuuauacag

SEQ ID NO: 7706 - RNA, 22 nt, Vaccinia virus
ccauauauuuuaaaacauugac

SEQ ID NO: 7707 - RNA, 22 nt, Vaccinia virus
uuucacacaaguuuuuauacag

SEQ ID NO: 7708 - RNA, 22 nt, Vaccinia virus
ccauauauuuuaaaacauugac

SEQ ID NO: 7709 - RNA, 22 nt, Vaccinia virus
uugacuuugaucgaugaaggcu

SEQ ID NO: 7710 - RNA, 19 nt, Vaccinia virus
ccauuuuuaugaucgucuu

SEQ ID NO: 7711 - RNA, 22 nt, Vaccinia virus
uuagaucugcauucauuauuau

SEQ ID NO: 7712 - RNA, 22 nt, Vaccinia virus
uaauauucuaauaagauuaagu

SEQ ID NO: 7713 - RNA, 22 nt, Vaccinia virus
uaaagagaaaucaguuuaggaa

SEQ ID NO: 7714 - RNA, 22 nt, Vaccinia virus
ucuacaucaucacgucucugua

SEQ ID NO: 7715 - RNA, 22 nt, Vaccinia virus
uuaaugagaaacuuaaaguaga

SEQ ID NO: 7716 - RNA, 21 nt, Vaccinia virus
uauuugacuuugucaacuuug

SEQ ID NO: 7717 - RNA, 22 nt, Vaccinia virus
uuauguauccuaguuucaaugu

SEQ ID NO: 7718 - RNA, 20 nt, Vaccinia virus
ugugcugcucuuauugucug

SEQ ID NO: 7719 - RNA, 22 nt, Vaccinia virus
uccaauuaaucccauguuagcg

SEQ ID NO: 7720 - RNA, 22 nt, Vaccinia virus
gucaauaaggcguuuaaaaaau

SEQ ID NO: 7721 - RNA, 22 nt, Vaccinia virus
uucaauugauaagacacgguag

SEQ ID NO: 7722 - RNA, 22 nt, Vaccinia virus
caaauauauuauuaauaauuug

SEQ ID NO: 7723 - RNA, 22 nt, Vaccinia virus
uucuuugacuugaauacuaucc

SEQ ID NO: 7724 - RNA, 21 nt, Vaccinia virus
uccacuaguuuagauucaaca

SEQ ID NO: 7725 - RNA, 22 nt, Vaccinia virus
ucuccaaucauauagauauuuu

SEQ ID NO: 7726 - RNA, 22 nt, Vaccinia virus
aauauuuguaaugguucuuuuc

SEQ ID NO: 7727 - RNA, 22 nt, Vaccinia virus
uucuccauagcuaucaagucuu

SEQ ID NO: 7728 - RNA, 16 nt, Vaccinia virus
ugaauacuuuauacuu

SEQ ID NO: 7729 - RNA, 22 nt, Vaccinia virus
uucugaacguugauagucuacu

SEQ ID NO: 7730 - RNA, 17 nt, Vaccinia virus
caucuaaugccuguaua

SEQ ID NO: 7731 - RNA, 22 nt, Vaccinia virus
uucugaacguugauagucuacu

SEQ ID NO: 7732 - RNA, 17 nt, Vaccinia virus
caucuaaugccuguaua

SEQ ID NO: 7733 - RNA, 22 nt, Vaccinia virus
uucuuuaucgcuaucuucauca

SEQ ID NO: 7734 - RNA, 20 nt, Vaccinia virus
ucaacaagucccagauuacg

SEQ ID NO: 7735 - RNA, 22 nt, Vaccinia virus
uuucagauucggagauccuaug

SEQ ID NO: 7736 - RNA, 22 nt, Vaccinia virus
uagaucacgaacaugugcaaua

SEQ ID NO: 7737 - RNA, 22 nt, Vaccinia virus
uuuagccuguuauuucuagucu

SEQ ID NO: 7738 - RNA, 20 nt, Vaccinia virus
agagacuauuacuaggcaug

SEQ ID NO: 7739 - RNA, 22 nt, Vaccinia virus
uuuagcaugauuucuggugaua

SEQ ID NO: 7740 - RNA, 22 nt, Vaccinia virus
uaucaucuauuagagaucuaaa

SEQ ID NO: 7741 - RNA, 22 nt, Vaccinia virus
uaaacagucuccucgauaauaa

SEQ ID NO: 7742 - RNA, 22 nt, Vaccinia virus
uauuaaauacucgagucauuuu

SEQ ID NO: 7743 - RNA, 22 nt, Vaccinia virus
uuuauuuccacauuagauggua

SEQ ID NO: 7744 - RNA, 20 nt, Vaccinia virus
uaucuuuuuaggaauguaug

SEQ ID NO: 7745 - RNA, 22 nt, Vaccinia virus
uuuuggccaaaaugauagauau

SEQ ID NO: 7746 - RNA, 20 nt, Vaccinia virus
uaguaaaauauuauuagucg

SEQ ID NO: 7747 - RNA, 22 nt, Vaccinia virus
uauaauuucccaaauacacauu

SEQ ID NO: 7748 - RNA, 22 nt, Vaccinia virus
ucauuauagugggagauuuggc

SEQ ID NO: 7749 - RNA, 22 nt, Vaccinia virus
uuuucagaugccucuuuuaguu

SEQ ID NO: 7750 - RNA, 20 nt, Vaccinia virus
cgcuccccuagucguacuca

SEQ ID NO: 7751 - RNA, 22 nt, Vaccinia virus
uuuucaccauuacuucuuccau

SEQ ID NO: 7752 - RNA, 22 nt, Vaccinia virus
ugugagaauacuaaaauuccua

SEQ ID NO: 7753 - RNA, 22 nt, Vaccinia virus
uuuuuaugcuugcauuauuaau

SEQ ID NO: 7754 - RNA, 22 nt, Vaccinia virus
ugauuguguacgcaauaccaau

SEQ ID NO: 7755 - RNA, 22 nt, Human herpesvirus 1
aagcguucgcacuuuguccuaa

SEQ ID NO: 7756 - RNA, 22 nt, Human herpesvirus 1
uaggacaaagugcgaacgcuuc

SEQ ID NO: 7757 - RNA, 22 nt, Human herpesvirus 1
aagcguucgcacuuuguccuaa

SEQ ID NO: 7758 - RNA, 22 nt, Human herpesvirus 1
uaggacaaagugcgaacgcuuc

SEQ ID NO: 7759 - RNA, 22 nt, Human herpesvirus 1
cgcccaccgauccccugcgcac

SEQ ID NO: 7760 - RNA, 22 nt, Human herpesvirus 1
cgcggccggggccucgaugugg

SEQ ID NO: 7761 - RNA, 22 nt, Human herpesvirus 1
ggcacgcgcgauagagucgacg

SEQ ID NO: 7762 - RNA, 22 nt, Human herpesvirus 1
ucgacucuaucgcgcgcauugu

SEQ ID NO: 7763 - RNA, 22 nt, Human herpesvirus 1
cgcccggcggguccgcuguaac

SEQ ID NO: 7764 - RNA, 22 nt, Human herpesvirus 1
uaacaggcgcggaucaguaccg

SEQ ID NO: 7765 - RNA, 22 nt, Human herpesvirus 1
ugccugcuggcggcccuggcca

SEQ ID NO: 7766 - RNA, 22 nt, Human herpesvirus 1
gacacggccgccugggcgggca

SEQ ID NO: 7767 - RNA, 22 nt, Human herpesvirus 1
ggauggccgggugguugauggu

SEQ ID NO: 7768 - RNA, 22 nt, Human herpesvirus 1
ucgcggcgcgccuggucguugu

SEQ ID NO: 7769 - RNA, 22 nt, Human herpesvirus 1
cggcgcuguggccucccguucc

SEQ ID NO: 7770 - RNA, 22 nt, Human herpesvirus 1
gugaggccacagcggcaccccg

SEQ ID NO: 7771 - RNA, 22 nt, Human herpesvirus 1
cggcgucgccugcacaggaagg

SEQ ID NO: 7772 - RNA, 22 nt, Human herpesvirus 1
cgguuggcggcgacgcuucggg

SEQ ID NO: 7773 - RNA, 22 nt, Human herpesvirus 1
gggccgugccgacucgguuuuu

SEQ ID NO: 7774 - RNA, 18 nt, Human herpesvirus 1
gcguggaccccguucccc

SEQ ID NO: 7775 - RNA, 22 nt, Human herpesvirus 1
caucgcgcccuuucgccaccug

SEQ ID NO: 7776 - RNA, 22 nt, Human herpesvirus 1
gcgucucgcgagggggcgcggc

SEQ ID NO: 7777 - RNA, 22 nt, Human herpesvirus 1
uucgcgggcgacgccccggccg

SEQ ID NO: 7778 - RNA, 21 nt, Human herpesvirus 1
cccgcguuuggccugcggcgc

SEQ ID NO: 7779 - RNA, 22 nt, Human herpesvirus 1
cggccgugugggcgcccgagcu

SEQ ID NO: 7780 - RNA, 22 nt, Human herpesvirus 1
caguacgcccugaucacgcggc

SEQ ID NO: 7781 - RNA, 22 nt, Human herpesvirus 1
gggcgcgccgcugcggcccgug

SEQ ID NO: 7782 - RNA, 22 nt, Human herpesvirus 1
cuggggcgcgaggcggugcgcg

SEQ ID NO: 7783 - RNA, 22 nt, Human herpesvirus 1
ccccgagccacgccagaaccuu

SEQ ID NO: 7784 - RNA, 22 nt, Human herpesvirus 1
acgggguggcguggcuucgggg

SEQ ID NO: 7785 - RNA, 22 nt, Human herpesvirus 1
ccaggccccuaggucgcgacgg

SEQ ID NO: 7786 - RNA, 22 nt, Human herpesvirus 1
gucggccgcggggcuuugcggg

SEQ ID NO: 7787 - RNA, 22 nt, Human herpesvirus 1
gccuuuuuucacaccgcguaug

SEQ ID NO: 7788 - RNA, 22 nt, Human herpesvirus 1
cacaccuggggggacggggcgg

SEQ ID NO: 7789 - RNA, 22 nt, Human herpesvirus 1
uaucccacccuggagcucaauc

SEQ ID NO: 7790 - RNA, 22 nt, Human herpesvirus 1
uugcggguccagagggcaacgc

SEQ ID NO: 7791 - RNA, 22 nt, Human herpesvirus 1
gccugcuggcggcccuggccaa

SEQ ID NO: 7792 - RNA, 21 nt, Human herpesvirus 1
gacacggccgccugggcgggc

SEQ ID NO: 7793 - RNA, 22 nt, Human herpesvirus 1
uaggcccguccggccguggggg

SEQ ID NO: 7794 - RNA, 22 nt, Human herpesvirus 1
cccgaggucggccagggccgcc

SEQ ID NO: 7795 - RNA, 22 nt, Human herpesvirus 1
cccgcgagucggagcuggagcu

SEQ ID NO: 7796 - RNA, 21 nt, Human herpesvirus 1
uuugacucacgcgcucgcggg

SEQ ID NO: 7797 - RNA, 22 nt, Human herpesvirus 1
gcggccgugcgggcgcaccgcg

SEQ ID NO: 7798 - RNA, 22 nt, Human herpesvirus 1
cggugacggcccugggcgcggc

SEQ ID NO: 7799 - RNA, 22 nt, Human herpesvirus 1
uggcgguugguccagacgcggg

SEQ ID NO: 7800 - RNA, 22 nt, Human herpesvirus 1
cguuacgugugccugccguccg

SEQ ID NO: 7801 - RNA, 22 nt, Human herpesvirus 1
ggggggugcucugauagucucg

SEQ ID NO: 7802 - RNA, 20 nt, Human herpesvirus 1
cgugaucgggguacuucgcc

SEQ ID NO: 7803 - RNA, 22 nt, Human herpesvirus 1
caucccuguuuuuaguccgcgc

SEQ ID NO: 7804 - RNA, 22 nt, Human herpesvirus 1
guggaccagaaggcggaccagg

SEQ ID NO: 7805 - RNA, 22 nt, Human herpesvirus 1
uggggaaucgcguagguggcgc

SEQ ID NO: 7806 - RNA, 22 nt, Human herpesvirus 1
caggucguacguggcccccgcg

SEQ ID NO: 7807 - RNA, 22 nt, Human herpesvirus 1
aaaggggucugcaaccaaaggu

SEQ ID NO: 7808 - RNA, 22 nt, Human herpesvirus 1
cuuuggaucccgaccccucuuc

SEQ ID NO: 7809 - RNA, 22 nt, Human herpesvirus 1
gcgcgcgcgcgcaaaaaaggcg

SEQ ID NO: 7810 - RNA, 22 nt, Human herpesvirus 1
gggcggcgugcgcgcgcgcggc

SEQ ID NO: 7811 - RNA, 22 nt, Human herpesvirus 1
ggcggcggugggcaucagcgcg

SEQ ID NO: 7812 - RNA, 22 nt, Human herpesvirus 1
ugcgcaggccguguuucaucau

SEQ ID NO: 7813 - RNA, 22 nt, Human herpesvirus 1
uccugucgggucacgaaugcga

SEQ ID NO: 7814 - RNA, 22 nt, Human herpesvirus 1
uacgccguguccuucacggggc

SEQ ID NO: 7815 - RNA, 22 nt, Human herpesvirus 1
uucaggcaggccgugugcaggc

SEQ ID NO: 7816 - RNA, 22 nt, Human herpesvirus 1
gguugucguugccgcgggugca

SEQ ID NO: 7817 - RNA, 21 nt, Human herpesvirus 1
ccgcccauccgcggccccucc

SEQ ID NO: 7818 - RNA, 22 nt, Human herpesvirus 1
uggguucggggggcccgggggg

SEQ ID NO: 7819 - RNA, 22 nt, Human herpesvirus 1
uccggccccuccggacccagcg

SEQ ID NO: 7820 - RNA, 22 nt, Human herpesvirus 1
gccauggcggccggccgcuucg

SEQ ID NO: 7821 - RNA, 20 nt, Human herpesvirus 1
cacgcggcggccgccguggc

SEQ ID NO: 7822 - RNA, 22 nt, Human herpesvirus 1
acaggauagcuuccggagucuc

SEQ ID NO: 7823 - RNA, 22 nt, Human herpesvirus 1
ugugagacuucgggggcgcugg

SEQ ID NO: 7824 - RNA, 22 nt, Human herpesvirus 1
ugccgcacgcggugggggccga

SEQ ID NO: 7825 - RNA, 21 nt, Human herpesvirus 1
caaccccgacgugcguugcac

SEQ ID NO: 7826 - RNA, 22 nt, Human herpesvirus 1
ucgcacucgucccuggcucagg

SEQ ID NO: 7827 - RNA, 22 nt, Human herpesvirus 1
ucugugccgggcgcgugcgacg

SEQ ID NO: 7828 - RNA, 22 nt, Human herpesvirus 1
ucgcacucgucccuggcucagg

SEQ ID NO: 7829 - RNA, 22 nt, Human herpesvirus 1
ucugugccgggcgcgugcgacg

SEQ ID NO: 7830 - RNA, 22 nt, Human herpesvirus 1
uaaggcgucgcggcguccugga

SEQ ID NO: 7831 - RNA, 22 nt, Human herpesvirus 1
uuuggugggauuugcggcgcca

SEQ ID NO: 7832 - RNA, 22 nt, Human herpesvirus 1
cggggggugggaccugucggga

SEQ ID NO: 7833 - RNA, 22 nt, Human herpesvirus 1
cgaccucgccuacacucgaccc

SEQ ID NO: 7834 - RNA, 22 nt, Human herpesvirus 1
ugcagcagagccagcagccgcu

SEQ ID NO: 7835 - RNA, 22 nt, Human herpesvirus 1
gagggcugcuccccgagcugca

SEQ ID NO: 7836 - RNA, 22 nt, Human herpesvirus 1
ggauugguuagacccauggguu

SEQ ID NO: 7837 - RNA, 22 nt, Human herpesvirus 1
ccuauaagacucucccccaccg

SEQ ID NO: 7838 - RNA, 22 nt, Human herpesvirus 1
cgccgucgaagcccucggccag

SEQ ID NO: 7839 - RNA, 22 nt, Human herpesvirus 1
gcggccaggcacucgacggcca

SEQ ID NO: 7840 - RNA, 22 nt, Human herpesvirus 1
agucugccuggcugcugcgucu

SEQ ID NO: 7841 - RNA, 22 nt, Human herpesvirus 1
ggugcaaaugcgaccagacugu

SEQ ID NO: 7842 - RNA, 22 nt, Human herpesvirus 1
agucugccuggcugcugcgucu

SEQ ID NO: 7843 - RNA, 22 nt, Human herpesvirus 1
ggugcaaaugcgaccagacugu

SEQ ID NO: 7844 - RNA, 22 nt, Human herpesvirus 1
cagggcguuguucuggucaagg

SEQ ID NO: 7845 - RNA, 20 nt, Human herpesvirus 1
ugacgacaacaacgcccaug

SEQ ID NO: 7846 - RNA, 22 nt, Human herpesvirus 1
gacgccccgcccgucacggggg

SEQ ID NO: 7847 - RNA, 22 nt, Human herpesvirus 1
ucugcgugggggggcgcggggc

SEQ ID NO: 7848 - RNA, 22 nt, Human herpesvirus 1
agcuuguuuucgugggggacga

SEQ ID NO: 7849 - RNA, 21 nt, Human herpesvirus 1
caagcuuuccgagggcgagcu

SEQ ID NO: 7850 - RNA, 22 nt, Human herpesvirus 1
gccccccgggccuccggagagg

SEQ ID NO: 7851 - RNA, 21 nt, Human herpesvirus 1
cgcucggcggcccgggcgggc

SEQ ID NO: 7852 - RNA, 22 nt, Human herpesvirus 1
uagauguacguaaugaauucac

SEQ ID NO: 7853 - RNA, 22 nt, Human herpesvirus 1
ucguggguuaugaacuucucca

SEQ ID NO: 7854 - RNA, 22 nt, Human herpesvirus 1
gcugcccgcugauggggucucg

SEQ ID NO: 7855 - RNA, 22 nt, Human herpesvirus 1
cccggcggugguuguaguagau

SEQ ID NO: 7856 - RNA, 22 nt, Human herpesvirus 1
uggccagguuguccgccguaca

SEQ ID NO: 7857 - RNA, 22 nt, Human herpesvirus 1
ucgcuggaugucccgaaggcca

SEQ ID NO: 7858 - RNA, 22 nt, Human herpesvirus 1
ucgguggggcccggggagccgg

SEQ ID NO: 7859 - RNA, 21 nt, Human herpesvirus 1
uucuccgacgccaucgccgau

SEQ ID NO: 7860 - RNA, 22 nt, Human herpesvirus 1
uggggccccgggccggggcccc

SEQ ID NO: 7861 - RNA, 22 nt, Human herpesvirus 1
gccccgggccgggccgccacgg

SEQ ID NO: 7862 - RNA, 22 nt, Human herpesvirus 1
ccgugugggcgcccgagcuggg

SEQ ID NO: 7863 - RNA, 22 nt, Human herpesvirus 1
cagcaguacgcccugaucacgc

SEQ ID NO: 7864 - RNA, 22 nt, Human herpesvirus 1
acggggugcucccggcggcccc

SEQ ID NO: 7865 - RNA, 20 nt, Human herpesvirus 1
cgggacgcgaguacccacgu

SEQ ID NO: 7866 - RNA, 22 nt, Human herpesvirus 1
guccucgagacggccgccagcg

SEQ ID NO: 7867 - RNA, 22 nt, Human herpesvirus 1
ccgcgggccgccgcucucccgg

SEQ ID NO: 7868 - RNA, 22 nt, Human herpesvirus 1
cgaaaaccccccgggggcucuu

SEQ ID NO: 7869 - RNA, 22 nt, Human herpesvirus 1
ggcccccgguaucgggucuuug

SEQ ID NO: 7870 - RNA, 22 nt, Human herpesvirus 1
ucagcucuucggacgcuuugug

SEQ ID NO: 7871 - RNA, 22 nt, Human herpesvirus 1
aggcgagauggggggccucgau

SEQ ID NO: 7872 - RNA, 22 nt, Human herpesvirus 1
uugucgggaucgugcgggccgg

SEQ ID NO: 7873 - RNA, 22 nt, Human herpesvirus 1
cgugggcgggggugcucgucga

SEQ ID NO: 7874 - RNA, 22 nt, Human herpesvirus 1
uauauagggucaggggguuccg

SEQ ID NO: 7875 - RNA, 22 nt, Human herpesvirus 1
gcgcccccggucccuguauaua

SEQ ID NO: 7876 - RNA, 22 nt, Human herpesvirus 1
cgggaggggccgcggaugggcg

SEQ ID NO: 7877 - RNA, 22 nt, Human herpesvirus 1
uccguuggguuuucuuugugcc

SEQ ID NO: 7878 - RNA, 18 nt, Human herpesvirus 1
auaccccguaaacggcgg

SEQ ID NO: 7879 - RNA, 22 nt, Human herpesvirus 1
ugcccccgaagccacgccaccc

SEQ ID NO: 7880 - RNA, 19 nt, Human herpesvirus 1
gcguggcucggggucgcgg

SEQ ID NO: 7881 - RNA, 22 nt, Human herpesvirus 1
gcccagcgcgaucuacgggagc

SEQ ID NO: 7882 - RNA, 19 nt, Human herpesvirus 1
ccgaggcgucgcugccggc

SEQ ID NO: 7883 - RNA, 22 nt, Human herpesvirus 1
ccggggugguaagguucgcgcu

SEQ ID NO: 7884 - RNA, 21 nt, Human herpesvirus 1
cgggaccggcgccaucuugag

SEQ ID NO: 7885 - RNA, 22 nt, Human herpesvirus 1
ucauagugcaaaaggggggaug

SEQ ID NO: 7886 - RNA, 20 nt, Human herpesvirus 1
gcuccuaagggcacuaugac

SEQ ID NO: 7887 - RNA, 22 nt, Human herpesvirus 1
uguccuccggaagggcccccaa

SEQ ID NO: 7888 - RNA, 22 nt, Human herpesvirus 1
cgggcaaggucggcgggaugag

SEQ ID NO: 7889 - RNA, 22 nt, Human herpesvirus 1
uacgucgugaccuaccucgggg

SEQ ID NO: 7890 - RNA, 22 nt, Human herpesvirus 1
cgaggagugcauggccguguac

SEQ ID NO: 7891 - RNA, 22 nt, Human herpesvirus 1
gccgaaccccaugaccucgagg

SEQ ID NO: 7892 - RNA, 22 nt, Human herpesvirus 1
ucgaacuccuccccgugaaagu

SEQ ID NO: 7893 - RNA, 22 nt, Human herpesvirus 1
ggucuggguuaggaagggccac

SEQ ID NO: 7894 - RNA, 22 nt, Human herpesvirus 1
ggcucggugaggaccguuagac

SEQ ID NO: 7895 - RNA, 22 nt, Human herpesvirus 1
ugugcacggaugagaucgcgcc

SEQ ID NO: 7896 - RNA, 19 nt, Human herpesvirus 1
gacaccuucccgugcaugc

SEQ ID NO: 7897 - RNA, 22 nt, Human herpesvirus 1
ugugcacggaugagaucgcgcc

SEQ ID NO: 7898 - RNA, 19 nt, Human herpesvirus 1
gacaccuucccgugcaugc

SEQ ID NO: 7899 - RNA, 22 nt, Human herpesvirus 1
ggacgccgaucccgacuccccg

SEQ ID NO: 7900 - RNA, 21 nt, Human herpesvirus 1
uguggucggcgucggugaucc

SEQ ID NO: 7901 - RNA, 22 nt, Human herpesvirus 1
ccucgcccggcagcggcgagua

SEQ ID NO: 7902 - RNA, 19 nt, Human herpesvirus 1
cacguccucggggucgggg

SEQ ID NO: 7903 - RNA, 22 nt, Human herpesvirus 1
ccucgcccggcagcggcgagua

SEQ ID NO: 7904 - RNA, 19 nt, Human herpesvirus 1
cacguccucggggucgggg

SEQ ID NO: 7905 - RNA, 22 nt, Human herpesvirus 1
gcgccucgcgcaguucuuccgg

SEQ ID NO: 7906 - RNA, 22 nt, Human herpesvirus 1
uggaccggccccgcggggacgc

SEQ ID NO: 7907 - RNA, 22 nt, Human herpesvirus 1
uucccuggugcccggggcccag

SEQ ID NO: 7908 - RNA, 16 nt, Human herpesvirus 1
ccccacgcuaagggag

SEQ ID NO: 7909 - RNA, 22 nt, Human herpesvirus 1
cgggccggcuccgcgggccagg

SEQ ID NO: 7910 - RNA, 21 nt, Human herpesvirus 1
ucgggccccaggcacggcccg

SEQ ID NO: 7911 - RNA, 22 nt, Human herpesvirus 1
ucauagugcccuuaggagcuuc

SEQ ID NO: 7912 - RNA, 22 nt, Human herpesvirus 1
gcauccccccuuuugcacuaug

SEQ ID NO: 7913 - RNA, 22 nt, Human herpesvirus 1
cgccccgcccgucacggggggc

SEQ ID NO: 7914 - RNA, 22 nt, Human herpesvirus 1
cucugcgugggggggcgcgggg

SEQ ID NO: 7915 - RNA, 22 nt, Human herpesvirus 1
agcugcccgugcguggauuugu

SEQ ID NO: 7916 - RNA, 22 nt, Human herpesvirus 1
ggaagccgggacggaugggcgg

SEQ ID NO: 7917 - RNA, 22 nt, Human herpesvirus 1
cguccucgccgacccgggcuuc

SEQ ID NO: 7918 - RNA, 18 nt, Human herpesvirus 1
cccugguggucggggacg

SEQ ID NO: 7919 - RNA, 22 nt, Human herpesvirus 1
gaucuuuggggagcagguguuc

SEQ ID NO: 7920 - RNA, 22 nt, Human herpesvirus 1
acacucgcaauucagucgguau

SEQ ID NO: 7921 - RNA, 22 nt, Human herpesvirus 1
uguggggcgugacggaaccacc

SEQ ID NO: 7922 - RNA, 15 nt, Human herpesvirus 1
gcgggaugcuccgca

SEQ ID NO: 7923 - RNA, 22 nt, Human herpesvirus 1
uccugaccgcggguuccgaguu

SEQ ID NO: 7924 - RNA, 22 nt, Human herpesvirus 1
ccugggacugugcgguugggac

SEQ ID NO: 7925 - RNA, 22 nt, Human herpesvirus 1
ccgcgggcgcgcgcgcgcgcaa

SEQ ID NO: 7926 - RNA, 22 nt, Human herpesvirus 1
cgcgcgcgcggcgggcgugggg

SEQ ID NO: 7927 - RNA, 22 nt, Human herpesvirus 1
ccgcgggcgcgcgcgcgcgcaa

SEQ ID NO: 7928 - RNA, 22 nt, Human herpesvirus 1
cgcgcgcgcggcgggcgugggg

SEQ ID NO: 7929 - RNA, 22 nt, Human herpesvirus 1
uggggguggucggggucguggu

SEQ ID NO: 7930 - RNA, 22 nt, Human herpesvirus 1
cuccuccgucuccgcgccccac

SEQ ID NO: 7931 - RNA, 22 nt, Human herpesvirus 1
ggggggcgggucuguugacaag

SEQ ID NO: 7932 - RNA, 20 nt, Human herpesvirus 1
cucggccgccccgccuccgc

SEQ ID NO: 7933 - RNA, 22 nt, Human herpesvirus 1
gcgggccuguuguuugucuugc

SEQ ID NO: 7934 - RNA, 20 nt, Human herpesvirus 1
ggcgggagacgcgggcccgc

SEQ ID NO: 7935 - RNA, 22 nt, Human herpesvirus 1
cguggcuuuuuguugccggcga

SEQ ID NO: 7936 - RNA, 22 nt, Human herpesvirus 1
cgucgguuguuauggccgcgag

SEQ ID NO: 7937 - RNA, 22 nt, Human herpesvirus 1
ugcagcaucuggucggccgugc

SEQ ID NO: 7938 - RNA, 22 nt, Human herpesvirus 1
gaggacggccuggacguugcga

SEQ ID NO: 7939 - RNA, 22 nt, Human herpesvirus 1
aaacacucucauucggaggcgg

SEQ ID NO: 7940 - RNA, 22 nt, Human herpesvirus 1
ggcacgcagaagagcgccgcga

SEQ ID NO: 7941 - RNA, 22 nt, Human herpesvirus 1
cgcaggugcaugccccagguuc

SEQ ID NO: 7942 - RNA, 22 nt, Human herpesvirus 1
acaccugcagcaaacggcacca

SEQ ID NO: 7943 - RNA, 22 nt, Human herpesvirus 1
uggccccaggccucgcccagcc

SEQ ID NO: 7944 - RNA, 22 nt, Human herpesvirus 1
gcggggcgcgcuggugggccag

SEQ ID NO: 7945 - RNA, 22 nt, Human herpesvirus 1
uccuggagacgggugagugucg

SEQ ID NO: 7946 - RNA, 20 nt, Human herpesvirus 1
guugcuuccagcuccggggc

SEQ ID NO: 7947 - RNA, 22 nt, Human herpesvirus 1
aggccgcagacgaggaaaauaa

SEQ ID NO: 7948 - RNA, 11 nt, Human herpesvirus 1
ugcuguggccu

SEQ ID NO: 7949 - RNA, 22 nt, Human herpesvirus 1
gcgcccguggggggugggcaca

SEQ ID NO: 7950 - RNA, 22 nt, Human herpesvirus 1
uguucuccgccuugaugucccg

SEQ ID NO: 7951 - RNA, 22 nt, Human herpesvirus 1
agugagggucgcgucgucuaug

SEQ ID NO: 7952 - RNA, 22 nt, Human herpesvirus 1
gagaacagcgucacccgauuac

SEQ ID NO: 7953 - RNA, 22 nt, Human herpesvirus 1
cgccccguccccccaggugugc

SEQ ID NO: 7954 - RNA, 22 nt, Human herpesvirus 1
uacgcggugugaaaaaaggcgu

SEQ ID NO: 7955 - RNA, 22 nt, Human herpesvirus 1
cguauuggucccaauggggucu

SEQ ID NO: 7956 - RNA, 22 nt, Human herpesvirus 1
gugccagcccugggaccgaacc

SEQ ID NO: 7957 - RNA, 22 nt, Human herpesvirus 1
cgucaccaugcagcgccggacg

SEQ ID NO: 7958 - RNA, 22 nt, Human herpesvirus 1
ggcuggcgcggugccugacgcc

SEQ ID NO: 7959 - RNA, 22 nt, Human herpesvirus 1
gcgcgcccgcccccagaaaggu

SEQ ID NO: 7960 - RNA, 21 nt, Human herpesvirus 1
ccagacguuuucgggccgcgc

SEQ ID NO: 7961 - RNA, 22 nt, Human herpesvirus 1
gggccggcuccgcgggccaggg

SEQ ID NO: 7962 - RNA, 20 nt, Human herpesvirus 1
ucgggccccaggcacggccc

SEQ ID NO: 7963 - RNA, 22 nt, Human herpesvirus 1
cacgcugggcuucgggaucgac

SEQ ID NO: 7964 - RNA, 21 nt, Human herpesvirus 1
cgccuccggggaccggugugc

SEQ ID NO: 7965 - RNA, 22 nt, Human herpesvirus 1
cggcgggcugacgaucggaggc

SEQ ID NO: 7966 - RNA, 22 nt, Human herpesvirus 1
ugguggaucggugggcccgccg

SEQ ID NO: 7967 - RNA, 22 nt, Human herpesvirus 1
ccgucaggugggccaggcgcuu

SEQ ID NO: 7968 - RNA, 22 nt, Human herpesvirus 1
gugucugcucaguucggcggug

SEQ ID NO: 7969 - RNA, 22 nt, Human herpesvirus 1
ccaugggcgguggaggaguucc

SEQ ID NO: 7970 - RNA, 21 nt, Human herpesvirus 1
agcucauccaacgccgcaugg

SEQ ID NO: 7971 - RNA, 22 nt, Human herpesvirus 1
gacccgccgcuuacgggggcgg

SEQ ID NO: 7972 - RNA, 22 nt, Human herpesvirus 1
guccuugagaagaaaggcgggg

SEQ ID NO: 7973 - RNA, 22 nt, Human herpesvirus 1
uuagcggggacuccggaugggc

SEQ ID NO: 7974 - RNA, 22 nt, Human herpesvirus 1
ucucucuggaccugcgaauggc

SEQ ID NO: 7975 - RNA, 22 nt, Human herpesvirus 1
agggggcgugaggaccgggagg

SEQ ID NO: 7976 - RNA, 13 nt, Human herpesvirus 1
cggagcguccccu

SEQ ID NO: 7977 - RNA, 22 nt, Human herpesvirus 1
cgggccguggccgagaucgucu

SEQ ID NO: 7978 - RNA, 20 nt, Human herpesvirus 1
aagugcgcguucaugguucg

SEQ ID NO: 7979 - RNA, 22 nt, Human herpesvirus 1
uugggugggguugauacgggaa

SEQ ID NO: 7980 - RNA, 18 nt, Human herpesvirus 1
ucguccccgcccgcccag

SEQ ID NO: 7981 - RNA, 22 nt, Human herpesvirus 1
cggccugggugggcggagggaa

SEQ ID NO: 7982 - RNA, 19 nt, Human herpesvirus 1
cguccccguuccaaggccg

SEQ ID NO: 7983 - RNA, 22 nt, Human herpesvirus 1
gauccaggaugauguuugugau

SEQ ID NO: 7984 - RNA, 17 nt, Human herpesvirus 1
aauaucucguugcgauu

SEQ ID NO: 7985 - RNA, 22 nt, Human herpesvirus 1
uguguuuuguguuugugggaug

SEQ ID NO: 7986 - RNA, 22 nt, Human herpesvirus 1
caacauaaacaacuacacacag

SEQ ID NO: 7987 - RNA, 22 nt, Human herpesvirus 1
aggcccuagucagccaacucgg

SEQ ID NO: 7988 - RNA, 22 nt, Human herpesvirus 1
ggggagguguuuaacuuugggg

SEQ ID NO: 7989 - RNA, 22 nt, Human herpesvirus 1
uuaagaggaucgcggcgcucuu

SEQ ID NO: 7990 - RNA, 22 nt, Human herpesvirus 1
gaguguuucguuccuucccccu

SEQ ID NO: 7991 - RNA, 22 nt, Human herpesvirus 1
aaggaaagaggaaacaggccgc

SEQ ID NO: 7992 - RNA, 22 nt, Human herpesvirus 1
gggaguuuguguucccuuuucu

SEQ ID NO: 7993 - RNA, 22 nt, Human herpesvirus 1
cgccgucgaagcccucggccag

SEQ ID NO: 7994 - RNA, 22 nt, Human herpesvirus 1
gcggccaggcacucgacggcca

SEQ ID NO: 7995 - RNA, 22 nt, Human herpesvirus 1
ucgucgucagcaccgucaucca

SEQ ID NO: 7996 - RNA, 19 nt, Human herpesvirus 1
uguauuggugcgauggcga

SEQ ID NO: 7997 - RNA, 22 nt, Human herpesvirus 1
aaagacccgauaccgggggccg

SEQ ID NO: 7998 - RNA, 22 nt, Human herpesvirus 1
gaagagcccccgggggguuuuc

SEQ ID NO: 7999 - RNA, 22 nt, Human herpesvirus 1
uggggccccgggccggggcccc

SEQ ID NO: 8000 - RNA, 22 nt, Human herpesvirus 1
gccccgggccgggccgccacgg

SEQ ID NO: 8001 - RNA, 22 nt, Human herpesvirus 1
aagaggggucgggauccaaagg

SEQ ID NO: 8002 - RNA, 22 nt, Human herpesvirus 1
uuugguugcagaccccuuucuc

SEQ ID NO: 8003 - RNA, 22 nt, Human herpesvirus 1
aagaggggucgggauccaaagg

SEQ ID NO: 8004 - RNA, 22 nt, Human herpesvirus 1
uuugguugcagaccccuuucuc

SEQ ID NO: 8005 - RNA, 22 nt, Human herpesvirus 1
uguugcgcaauugcauccaggu

SEQ ID NO: 8006 - RNA, 20 nt, Human herpesvirus 1
augcagaagcggugcaugca

SEQ ID NO: 8007 - RNA, 22 nt, Human herpesvirus 1
ggcaaguaugccccccuggcga

SEQ ID NO: 8008 - RNA, 22 nt, Human herpesvirus 1
ccccacaacauggagcauacgc

SEQ ID NO: 8009 - RNA, 22 nt, Human herpesvirus 1
ccgacgccaacccaggccgcgg

SEQ ID NO: 8010 - RNA, 22 nt, Human herpesvirus 1
gagcccgcaugggggguguccc

SEQ ID NO: 8011 - RNA, 22 nt, Human herpesvirus 1
ggcaugccaaacauccgggggg

SEQ ID NO: 8012 - RNA, 22 nt, Human herpesvirus 1
uccggcuccuggaggcaaaacu

SEQ ID NO: 8013 - RNA, 22 nt, Human herpesvirus 1
aggcgcaccccgaucgcacgcu

SEQ ID NO: 8014 - RNA, 22 nt, Human herpesvirus 1
ugcgcgaucgggcggcgccucg

SEQ ID NO: 8015 - RNA, 22 nt, Human herpesvirus 1
acgcguccacgaccugguuggc

SEQ ID NO: 8016 - RNA, 22 nt, Human herpesvirus 1
cuguugagauccccagguaggu

SEQ ID NO: 8017 - RNA, 22 nt, Human herpesvirus 1
cauccggaagcgggggccccgc

SEQ ID NO: 8018 - RNA, 22 nt, Human herpesvirus 1
ggcgccuccggaaccuccgggu

SEQ ID NO: 8019 - RNA, 22 nt, Human herpesvirus 1
ugcgauugguucugggggcacg

SEQ ID NO: 8020 - RNA, 22 nt, Human herpesvirus 1
gcagccccgggaccaccgcgac

SEQ ID NO: 8021 - RNA, 22 nt, Human herpesvirus 1
ugucgcgaucccccccgcguuc

SEQ ID NO: 8022 - RNA, 22 nt, Human herpesvirus 1
ugcgguggggugcccgcgauca

SEQ ID NO: 8023 - RNA, 22 nt, Human herpesvirus 1
ccagcgccauacguacuauagc

SEQ ID NO: 8024 - RNA, 21 nt, Human herpesvirus 1
ucaucgccccgcgggugcugg

SEQ ID NO: 8025 - RNA, 22 nt, Human herpesvirus 1
ggaggagucgccggauacgugg

SEQ ID NO: 8026 - RNA, 22 nt, Human herpesvirus 1
cggaucugguccuguugcuccu

SEQ ID NO: 8027 - RNA, 22 nt, Human herpesvirus 1
ggggcggccgucgccaguagcg

SEQ ID NO: 8028 - RNA, 22 nt, Human herpesvirus 1
cgaccgugaaaagccuggggcc

SEQ ID NO: 8029 - RNA, 22 nt, Human herpesvirus 1
cgccuucuccgugacauacagg

SEQ ID NO: 8030 - RNA, 20 nt, Human herpesvirus 1
uauggucgacguagggggcg

SEQ ID NO: 8031 - RNA, 22 nt, Human herpesvirus 1
ucucggcgggggccgucuggcc

SEQ ID NO: 8032 - RNA, 22 nt, Human herpesvirus 1
cgcagauagccgcccccuccga

SEQ ID NO: 8033 - RNA, 22 nt, Human herpesvirus 1
cgggggccacguacgaccugca

SEQ ID NO: 8034 - RNA, 22 nt, Human herpesvirus 1
ugcgccaccuacgcgauucccc

SEQ ID NO: 8035 - RNA, 22 nt, Human herpesvirus 1
gaggcggccugggucuuccgcg

SEQ ID NO: 8036 - RNA, 20 nt, Human herpesvirus 1
cuccgcaccaagccgcucuc

SEQ ID NO: 8037 - RNA, 22 nt, Human herpesvirus 1
cccguugaccagccgcgucaca

SEQ ID NO: 8038 - RNA, 20 nt, Human herpesvirus 1
gcauguaugcguucggcggg

SEQ ID NO: 8039 - RNA, 22 nt, Human herpesvirus 1
ggcggcguccggguuuuuugcg

SEQ ID NO: 8040 - RNA, 22 nt, Human herpesvirus 1
gagccagccggggacccccgcc

SEQ ID NO: 8041 - RNA, 22 nt, Human herpesvirus 1
ccguccccgccccguacgucgu

SEQ ID NO: 8042 - RNA, 19 nt, Human herpesvirus 1
gaugcgggggguggcacgg

SEQ ID NO: 8043 - RNA, 22 nt, Human herpesvirus 1
cgccccgcgcccccccacgcag

SEQ ID NO: 8044 - RNA, 20 nt, Human herpesvirus 1
cccccgugacgggcggggcg

SEQ ID NO: 8045 - RNA, 22 nt, Human herpesvirus 1
cgccccgcgcccccccacgcag

SEQ ID NO: 8046 - RNA, 20 nt, Human herpesvirus 1
cccccgugacgggcggggcg

SEQ ID NO: 8047 - RNA, 22 nt, Human herpesvirus 1
gcuagccugauuaaauacgccc

SEQ ID NO: 8048 - RNA, 20 nt, Human herpesvirus 1
ugagcggggggaagguuggc

SEQ ID NO: 8049 - RNA, 22 nt, Human herpesvirus 1
ucguccaggucgucgucauccu

SEQ ID NO: 8050 - RNA, 12 nt, Human herpesvirus 1
ugggugggcgac

SEQ ID NO: 8051 - RNA, 22 nt, Human herpesvirus 1
ugucgacgcccccucccuguuu

SEQ ID NO: 8052 - RNA, 22 nt, Human herpesvirus 1
uggcuccggggggcuuccggcc

SEQ ID NO: 8053 - RNA, 22 nt, Human herpesvirus 1
uuaggcuacgagucgcggugau

SEQ ID NO: 8054 - RNA, 22 nt, Human herpesvirus 1
gcugcguuugucugucuugguc

SEQ ID NO: 8055 - RNA, 22 nt, Human herpesvirus 1
uggacagucgauaagucgguag

SEQ ID NO: 8056 - RNA, 20 nt, Human herpesvirus 1
accuguuccgccugucgcac

SEQ ID NO: 8057 - RNA, 22 nt, Human herpesvirus 1
ugucgcgugucgcgcaugcgca

SEQ ID NO: 8058 - RNA, 20 nt, Human herpesvirus 1
uguggugccgccugugauac

SEQ ID NO: 8059 - RNA, 22 nt, Human herpesvirus 1
ggcgacguugcccgcgugaccc

SEQ ID NO: 8060 - RNA, 22 nt, Human herpesvirus 1
aaggagcugcgcgucaagagcc

SEQ ID NO: 8061 - RNA, 22 nt, Human herpesvirus 1
agcccuuguuuuacuagauacc

SEQ ID NO: 8062 - RNA, 22 nt, Human herpesvirus 1
ggggucaggucugcgggguugg

SEQ ID NO: 8063 - RNA, 22 nt, Human herpesvirus 1
gaugccuuucaaaccgaccagu

SEQ ID NO: 8064 - RNA, 21 nt, Human herpesvirus 1
ucgaccgggucucgagguauc

SEQ ID NO: 8065 - RNA, 22 nt, Human herpesvirus 1
uccucccgggagagcggcggcc

SEQ ID NO: 8066 - RNA, 22 nt, Human herpesvirus 1
gcuggcggccgucucgaggacg

SEQ ID NO: 8067 - RNA, 22 nt, Human herpesvirus 1
ucggugcaggaacacacgggcg

SEQ ID NO: 8068 - RNA, 16 nt, Human herpesvirus 1
uccgccguggggccga

SEQ ID NO: 8069 - RNA, 22 nt, Human herpesvirus 1
gggggggagccccccccgcgag

SEQ ID NO: 8070 - RNA, 19 nt, Human herpesvirus 1
ugcgggggcgcccccccuc

SEQ ID NO: 8071 - RNA, 22 nt, Human herpesvirus 1
ccggacugaccuggccucuggc

SEQ ID NO: 8072 - RNA, 22 nt, Human herpesvirus 1
ggggguuaacuacacuauaggg

SEQ ID NO: 8073 - RNA, 22 nt, Human herpesvirus 1
uuguuuauguuggaugccugug

SEQ ID NO: 8074 - RNA, 22 nt, Human herpesvirus 1
ccccuccaucccacaaacacaa

SEQ ID NO: 8075 - RNA, 22 nt, Human herpesvirus 1
cggacggaacaccgcaguuucu

SEQ ID NO: 8076 - RNA, 14 nt, Human herpesvirus 1
agggacgccgucug

SEQ ID NO: 8077 - RNA, 22 nt, Human herpesvirus 1
gagggggaacucgugggugcug

SEQ ID NO: 8078 - RNA, 19 nt, Human herpesvirus 1
auucuuacccgccccccuu

SEQ ID NO: 8079 - RNA, 22 nt, Human herpesvirus 1
cgcccgcacgcgcagcccggau

SEQ ID NO: 8080 - RNA, 21 nt, Human herpesvirus 1
gggcugguucgcagcgaggug

SEQ ID NO: 8081 - RNA, 22 nt, Human herpesvirus 1
ggccuguacgucccucggcccg

SEQ ID NO: 8082 - RNA, 21 nt, Human herpesvirus 1
ggccgaugccaucaacgggcu

SEQ ID NO: 8083 - RNA, 22 nt, Human herpesvirus 1
ucgagcacguagcccugcacca

SEQ ID NO: 8084 - RNA, 22 nt, Human herpesvirus 1
ugacggggguucgcgaagacgg

SEQ ID NO: 8085 - RNA, 22 nt, Human herpesvirus 1
ggucucuagcguggucgcccug

SEQ ID NO: 8086 - RNA, 20 nt, Human herpesvirus 1
caagacuaucacgggggacu

SEQ ID NO: 8087 - RNA, 22 nt, Human herpesvirus 1
ucuccgaggaggacgaccuggg

SEQ ID NO: 8088 - RNA, 20 nt, Human herpesvirus 1
cccgguaacgucccggggau

SEQ ID NO: 8089 - RNA, 22 nt, Human herpesvirus 1
cggggggaggagcggggggagg

SEQ ID NO: 8090 - RNA, 21 nt, Human herpesvirus 1
ccccccaaaacacaccccccg

SEQ ID NO: 8091 - RNA, 22 nt, Human herpesvirus 1
agcagguaguaccgagugguga

SEQ ID NO: 8092 - RNA, 22 nt, Human herpesvirus 1
uuuuucguccggcccgaauuug

SEQ ID NO: 8093 - RNA, 22 nt, Human herpesvirus 1
cgggccgccgcggcgcaggccc

SEQ ID NO: 8094 - RNA, 18 nt, Human herpesvirus 1
ccgugucgcgccggcccg

SEQ ID NO: 8095 - RNA, 22 nt, Human herpesvirus 1
ccacgcccgccgcgcgcgcgca

SEQ ID NO: 8096 - RNA, 22 nt, Human herpesvirus 1
cgcgcgcgcgcgcccgcggggg

SEQ ID NO: 8097 - RNA, 22 nt, Human herpesvirus 1
ccccacgcagggucugcgagca

SEQ ID NO: 8098 - RNA, 22 nt, Human herpesvirus 1
uacgccuaccucugccuggggu

SEQ ID NO: 8099 - RNA, 22 nt, Human herpesvirus 1
ggcgcugcguccgcgagcagcg

SEQ ID NO: 8100 - RNA, 15 nt, Human herpesvirus 1
cugcgggucagcguc

SEQ ID NO: 8101 - RNA, 22 nt, Human herpesvirus 1
uccugucgggucacgaaugcga

SEQ ID NO: 8102 - RNA, 22 nt, Human herpesvirus 1
uacgccguguccuucacggggc

SEQ ID NO: 8103 - RNA, 22 nt, Human herpesvirus 1
cacguacuccaagaaggcaugu

SEQ ID NO: 8104 - RNA, 22 nt, Human herpesvirus 1
ugccuggcucucuaugcuuggg

SEQ ID NO: 8105 - RNA, 22 nt, Human herpesvirus 1
cagucuggucgcauuugcaccu

SEQ ID NO: 8106 - RNA, 22 nt, Human herpesvirus 1
gacgcagcagccaggcagacuc

SEQ ID NO: 8107 - RNA, 22 nt, Human herpesvirus 1
cagucuggucgcauuugcaccu

SEQ ID NO: 8108 - RNA, 22 nt, Human herpesvirus 1
gacgcagcagccaggcagacuc

SEQ ID NO: 8109 - RNA, 22 nt, Human herpesvirus 1
aauaaccaaaaacaccacaggg

SEQ ID NO: 8110 - RNA, 22 nt, Human herpesvirus 1
gugauuguguguuuauuauuuu

SEQ ID NO: 8111 - RNA, 22 nt, Human herpesvirus 1
ccucuggcgucggcgcgugugg

SEQ ID NO: 8112 - RNA, 22 nt, Human herpesvirus 1
caccggcgucggcgcccgggcc

SEQ ID NO: 8113 - RNA, 22 nt, Human herpesvirus 1
gcugggccugaagcagguagua

SEQ ID NO: 8114 - RNA, 22 nt, Human herpesvirus 1
gagcaccaggcuuuuuucgucc

SEQ ID NO: 8115 - RNA, 22 nt, Human herpesvirus 1
agcagugcuuugccgccaaaug

SEQ ID NO: 8116 - RNA, 22 nt, Human herpesvirus 1
aaccgccugcacacgcuguuua

SEQ ID NO: 8117 - RNA, 22 nt, Human herpesvirus 1
ggcggucgggcgauugauauau

SEQ ID NO: 8118 - RNA, 21 nt, Human herpesvirus 1
gcauuagucccgaagaccgcc

SEQ ID NO: 8119 - RNA, 22 nt, Human herpesvirus 1
ccgggucggcgaggacguuggg

SEQ ID NO: 8120 - RNA, 22 nt, Human herpesvirus 1
ucgagggcggggaagcggaucu

SEQ ID NO: 8121 - RNA, 22 nt, Human herpesvirus 1
ucgggccgugccuggggcccga

SEQ ID NO: 8122 - RNA, 22 nt, Human herpesvirus 1
uggcccgcggagccggcccggc

SEQ ID NO: 8123 - RNA, 22 nt, Human herpesvirus 1
cgcggcggugguaaugacaagc

SEQ ID NO: 8124 - RNA, 16 nt, Human herpesvirus 1
caugccuuaugccgug

SEQ ID NO: 8125 - RNA, 22 nt, Human herpesvirus 1
uaagggguccguuguguuggcc

SEQ ID NO: 8126 - RNA, 22 nt, Human herpesvirus 1
ggcaagaacagcccccacgagg

SEQ ID NO: 8127 - RNA, 22 nt, Human herpesvirus 1
ucgagcguaccgacgggcggca

SEQ ID NO: 8128 - RNA, 22 nt, Human herpesvirus 1
gacuggccgucaggagcucggc

SEQ ID NO: 8129 - RNA, 22 nt, Human herpesvirus 1
ggugguacuggugccggucgug

SEQ ID NO: 8130 - RNA, 22 nt, Human herpesvirus 1
cccacgcuucccgccaacaccc

SEQ ID NO: 8131 - RNA, 22 nt, Human herpesvirus 1
ucucgccguccagguggcgaau

SEQ ID NO: 8132 - RNA, 22 nt, Human herpesvirus 1
uggcauccagagggcgcugaag

SEQ ID NO: 8133 - RNA, 22 nt, Human herpesvirus 1
ggucagccucgagcuggucgac

SEQ ID NO: 8134 - RNA, 22 nt, Human herpesvirus 1
ucgaagaggcucguguuguuuu

SEQ ID NO: 8135 - RNA, 22 nt, Human herpesvirus 1
gggggaguuugagacggccgag

SEQ ID NO: 8136 - RNA, 22 nt, Human herpesvirus 1
uccggucaacccagccuucucc

SEQ ID NO: 8137 - RNA, 22 nt, Human herpesvirus 1
cgggccugucguguagauucga

SEQ ID NO: 8138 - RNA, 21 nt, Human herpesvirus 1
uugugucgcagggcggcccgc

SEQ ID NO: 8139 - RNA, 22 nt, Human herpesvirus 1
ccccccgccucaccgucgucca

SEQ ID NO: 8140 - RNA, 22 nt, Human herpesvirus 1
gugggcuccgggugggugggcg

SEQ ID NO: 8141 - RNA, 22 nt, Human herpesvirus 1
cguaccgacggcggggugcccg

SEQ ID NO: 8142 - RNA, 22 nt, Human herpesvirus 1
caagcccucgcccuccccggga

SEQ ID NO: 8143 - RNA, 22 nt, Human herpesvirus 1
cccgcgcucgcgaguacuucca

SEQ ID NO: 8144 - RNA, 20 nt, Human herpesvirus 1
uaugucgcaacgccgcaggg

SEQ ID NO: 8145 - RNA, 22 nt, Human herpesvirus 1
ccggagggggugggugggcucc

SEQ ID NO: 8146 - RNA, 22 nt, Human herpesvirus 1
gcgccacggaccacugcuuggc

SEQ ID NO: 8147 - RNA, 22 nt, Human herpesvirus 1
ggggcgcuccugauguggcugc

SEQ ID NO: 8148 - RNA, 19 nt, Human herpesvirus 1
gcaucgacacgcgcguccu

SEQ ID NO: 8149 - RNA, 22 nt, Human herpesvirus 1
ccccugguccuggcccgcagac

SEQ ID NO: 8150 - RNA, 22 nt, Human herpesvirus 1
uguuuccgcccuugccgaaucc

SEQ ID NO: 8151 - RNA, 22 nt, Human herpesvirus 1
ucugcggugucggcggcggcug

SEQ ID NO: 8152 - RNA, 22 nt, Human herpesvirus 1
ccgccguguucggucucgguag

SEQ ID NO: 8153 - RNA, 22 nt, Human herpesvirus 1
ucugcggugucggcggcggcug

SEQ ID NO: 8154 - RNA, 22 nt, Human herpesvirus 1
ccgccguguucggucucgguag

SEQ ID NO: 8155 - RNA, 22 nt, Human herpesvirus 1
ugucgcauggggaaagugccca

SEQ ID NO: 8156 - RNA, 20 nt, Human herpesvirus 1
gcacgaggaccaacgcggca

SEQ ID NO: 8157 - RNA, 22 nt, Human herpesvirus 1
ggccgaacaggcgcugggaacc

SEQ ID NO: 8158 - RNA, 22 nt, Human herpesvirus 1
gacccuugcccuggagacggcc

SEQ ID NO: 8159 - RNA, 22 nt, Human herpesvirus 1
agcuggcggcgagauugaugcc

SEQ ID NO: 8160 - RNA, 22 nt, Human herpesvirus 1
uauacagacggagccguuggug

SEQ ID NO: 8161 - RNA, 22 nt, Human herpesvirus 1
aggaggaacguccucgucgagg

SEQ ID NO: 8162 - RNA, 14 nt, Human herpesvirus 1
guggaccgcuuccu

SEQ ID NO: 8163 - RNA, 22 nt, Human herpesvirus 1
aggaggaacguccucgucgagg

SEQ ID NO: 8164 - RNA, 14 nt, Human herpesvirus 1
guggaccgcuuccu

SEQ ID NO: 8165 - RNA, 22 nt, Human herpesvirus 1
ggacucaaccgccgaacccagg

SEQ ID NO: 8166 - RNA, 20 nt, Human herpesvirus 1
ugguguuuacgaacgaguuu

SEQ ID NO: 8167 - RNA, 22 nt, Human herpesvirus 1
ggggggacgcguggacuggggg

SEQ ID NO: 8168 - RNA, 21 nt, Human herpesvirus 1
uggcccgacccgcgccucuuc

SEQ ID NO: 8169 - RNA, 22 nt, Human herpesvirus 1
cgcacgacguguuucaggccac

SEQ ID NO: 8170 - RNA, 22 nt, Human herpesvirus 1
ccuguacgccaucagcgaauug

SEQ ID NO: 8171 - RNA, 22 nt, Human herpesvirus 1
cgugucggggaggcgcgcgacc

SEQ ID NO: 8172 - RNA, 22 nt, Human herpesvirus 1
acgcccauaagcuccucccgau

SEQ ID NO: 8173 - RNA, 22 nt, Human herpesvirus 1
ggggggaggagcggggggagga

SEQ ID NO: 8174 - RNA, 20 nt, Human herpesvirus 1
ccccccaaaacacacccccc

SEQ ID NO: 8175 - RNA, 22 nt, Human herpesvirus 1
cgcgccagucguucuagguuca

SEQ ID NO: 8176 - RNA, 22 nt, Human herpesvirus 1
uacgugcgggccaaggcgcggg

SEQ ID NO: 8177 - RNA, 22 nt, Human herpesvirus 1
ucuuauuugguauuaccugguu

SEQ ID NO: 8178 - RNA, 22 nt, Human herpesvirus 1
auacaguaagacaucccauggu

SEQ ID NO: 8179 - RNA, 22 nt, Human herpesvirus 1
ccgcuguggccucaccugacca

SEQ ID NO: 8180 - RNA, 22 nt, Human herpesvirus 1
cggaacgggaggccacagcgcc

SEQ ID NO: 8181 - RNA, 22 nt, Human herpesvirus 1
gcggggcucuggcugcgguuca

SEQ ID NO: 8182 - RNA, 21 nt, Human herpesvirus 1
gcggcccgcguggaccccgac

SEQ ID NO: 8183 - RNA, 22 nt, Human herpesvirus 1
ccucgucgaccagaucucgauc

SEQ ID NO: 8184 - RNA, 22 nt, Human herpesvirus 1
aaggucaucccgcauggucaug

SEQ ID NO: 8185 - RNA, 22 nt, Human herpesvirus 1
cgccuuccgggggggcccccaa

SEQ ID NO: 8186 - RNA, 21 nt, Human herpesvirus 1
uuggauuccccugacggggcg

SEQ ID NO: 8187 - RNA, 22 nt, Human herpesvirus 1
cgguugcccgcagcagagucug

SEQ ID NO: 8188 - RNA, 22 nt, Human herpesvirus 1
ggaauagguuguggccccggcu

SEQ ID NO: 8189 - RNA, 22 nt, Human herpesvirus 1
cgacucgagggcguucugcggc

SEQ ID NO: 8190 - RNA, 22 nt, Human herpesvirus 1
cccagcccgcuccgcuucucgc

SEQ ID NO: 8191 - RNA, 22 nt, Human herpesvirus 1
cccaugcggcguuggaugagcu

SEQ ID NO: 8192 - RNA, 21 nt, Human herpesvirus 1
aacuccuccaccgcccauggg

SEQ ID NO: 8193 - RNA, 22 nt, Human herpesvirus 1
cacguacuccaagaaggcaugu

SEQ ID NO: 8194 - RNA, 22 nt, Human herpesvirus 1
ugccuggcucucuaugcuuggg

SEQ ID NO: 8195 - RNA, 22 nt, Human herpesvirus 1
gccgcgcgcugcuggcgcucca

SEQ ID NO: 8196 - RNA, 20 nt, Human herpesvirus 1
ugcgcgccggagcucgcggu

SEQ ID NO: 8197 - RNA, 22 nt, Human herpesvirus 1
ccggggcugcccggccgugaag

SEQ ID NO: 8198 - RNA, 19 nt, Human herpesvirus 1
gcggccggccaccgccgcg

SEQ ID NO: 8199 - RNA, 22 nt, Human herpesvirus 1
ccggggcugcccggccgugaag

SEQ ID NO: 8200 - RNA, 19 nt, Human herpesvirus 1
gcggccggccaccgccgcg

SEQ ID NO: 8201 - RNA, 22 nt, Human herpesvirus 1
ccccgccgcuugaucauuauca

SEQ ID NO: 8202 - RNA, 21 nt, Human herpesvirus 1
uccggagaucaugcgcgggug

SEQ ID NO: 8203 - RNA, 22 nt, Human herpesvirus 1
ggcccccaucaccgccccuaac

SEQ ID NO: 8204 - RNA, 22 nt, Human herpesvirus 1
ugggggcgcguggggaggggcc

SEQ ID NO: 8205 - RNA, 22 nt, Human herpesvirus 1
ggccggccggcgcuuaggggga

SEQ ID NO: 8206 - RNA, 17 nt, Human herpesvirus 1
ccuuggccgccccggcu

SEQ ID NO: 8207 - RNA, 22 nt, Human herpesvirus 1
uggagucgaaggccagcgccag

SEQ ID NO: 8208 - RNA, 22 nt, Human herpesvirus 1
ccggcgcgcuccgcggccuccg

SEQ ID NO: 8209 - RNA, 22 nt, Human herpesvirus 1
gccgucccaaccgcacaguccc

SEQ ID NO: 8210 - RNA, 22 nt, Human herpesvirus 1
aacccgcggucaggagcgcgcc

SEQ ID NO: 8211 - RNA, 22 nt, Human herpesvirus 1
cgccuccaggugcgccacugcg

SEQ ID NO: 8212 - RNA, 22 nt, Human herpesvirus 1
gugcugaagcacagguuguggg

SEQ ID NO: 8213 - RNA, 22 nt, Human herpesvirus 1
ucggacggcaggcacacguaac

SEQ ID NO: 8214 - RNA, 20 nt, Human herpesvirus 1
ugugcgucgcccgcgucugg

SEQ ID NO: 8215 - RNA, 22 nt, Human herpesvirus 1
agacccaagcauagagagccag

SEQ ID NO: 8216 - RNA, 22 nt, Human herpesvirus 1
cuucuuggaguacgugggucau

SEQ ID NO: 8217 - RNA, 22 nt, Human herpesvirus 1
agacccaagcauagagagccag

SEQ ID NO: 8218 - RNA, 22 nt, Human herpesvirus 1
cuucuuggaguacgugggucau

SEQ ID NO: 8219 - RNA, 22 nt, Human herpesvirus 1
agcggggcccacgcggucaaug

SEQ ID NO: 8220 - RNA, 21 nt, Human herpesvirus 1
cucgcugacgguggcccgcuu

SEQ ID NO: 8221 - RNA, 22 nt, Human herpesvirus 1
gguuuugagcagcugggcaaag

SEQ ID NO: 8222 - RNA, 19 nt, Human herpesvirus 1
caccagcuggcgaaaggcu

SEQ ID NO: 8223 - RNA, 22 nt, Human herpesvirus 1
gauggccgucuuugacgagccg

SEQ ID NO: 8224 - RNA, 22 nt, Human herpesvirus 1
ccgcuguucgagggccaggaca

SEQ ID NO: 8225 - RNA, 22 nt, Human herpesvirus 1
acgguggacagcaucgggaugc

SEQ ID NO: 8226 - RNA, 22 nt, Human herpesvirus 1
uccccgagaaccagcgcaccgu

SEQ ID NO: 8227 - RNA, 22 nt, Human herpesvirus 1
cccccagagacuuguuguagga

SEQ ID NO: 8228 - RNA, 22 nt, Human herpesvirus 1
uccaugaccgugauggggauag

SEQ ID NO: 8229 - RNA, 22 nt, Human herpesvirus 1
gcguuugagcgcggcacggccg

SEQ ID NO: 8230 - RNA, 18 nt, Human herpesvirus 1
ugcugcuggaaaaggcgc

SEQ ID NO: 8231 - RNA, 22 nt, Human herpesvirus 1
ucuggggcgaacuguuuggcgu

SEQ ID NO: 8232 - RNA, 17 nt, Human herpesvirus 1
cgcagacguuucccggg

SEQ ID NO: 8233 - RNA, 22 nt, Human herpesvirus 1
agcugggggcguauuuaaucag

SEQ ID NO: 8234 - RNA, 19 nt, Human herpesvirus 1
ccugccguaguuucuggcu

SEQ ID NO: 8235 - RNA, 22 nt, Human herpesvirus 1
cguggcuuuuuguugccggcga

SEQ ID NO: 8236 - RNA, 22 nt, Human herpesvirus 1
cgucgguuguuauggccgcgag

SEQ ID NO: 8237 - RNA, 22 nt, Human herpesvirus 1
uucguggaagauaaagcgccgc

SEQ ID NO: 8238 - RNA, 22 nt, Human herpesvirus 1
ucguccgcgcggcccacgcagu

SEQ ID NO: 8239 - RNA, 22 nt, Human herpesvirus 1
ggguccgucacggggucgcugg

SEQ ID NO: 8240 - RNA, 16 nt, Human herpesvirus 1
cgaucuccgggaccac

SEQ ID NO: 8241 - RNA, 22 nt, Human herpesvirus 1
ugcccgggacccacguggcggc

SEQ ID NO: 8242 - RNA, 22 nt, Human herpesvirus 1
cgcgagggacacguggugcccg

SEQ ID NO: 8243 - RNA, 22 nt, Human herpesvirus 1
ccgcuggguccggaggggccgg

SEQ ID NO: 8244 - RNA, 22 nt, Human herpesvirus 1
cgggccccccgaacccagcggg

SEQ ID NO: 8245 - RNA, 22 nt, Human herpesvirus 1
ccuccuugaagcccucgguaac

SEQ ID NO: 8246 - RNA, 22 nt, Human herpesvirus 1
caggagggcgcgguccgggucc

SEQ ID NO: 8247 - RNA, 22 nt, Human herpesvirus 1
aggcgaccgcgcaccgacuggc

SEQ ID NO: 8248 - RNA, 22 nt, Human herpesvirus 1
ggggcgcugccgggacgcucgg

SEQ ID NO: 8249 - RNA, 22 nt, Human herpesvirus 1
gguggguccgugggggugucca

SEQ ID NO: 8250 - RNA, 17 nt, Human herpesvirus 1
ggccccucguuccuacc

SEQ ID NO: 8251 - RNA, 22 nt, Human herpesvirus 1
ugguguucgggaccugguaccg

SEQ ID NO: 8252 - RNA, 22 nt, Human herpesvirus 1
gaccgcaccaucacggacuuuc

SEQ ID NO: 8253 - RNA, 22 nt, Human herpesvirus 1
gaguuagacaggcaagcacuac

SEQ ID NO: 8254 - RNA, 16 nt, Human herpesvirus 1
cuugccugucaaacuc

SEQ ID NO: 8255 - RNA, 22 nt, Human herpesvirus 1
gaguuagacaggcaagcacuac

SEQ ID NO: 8256 - RNA, 16 nt, Human herpesvirus 1
cuugccugucaaacuc

SEQ ID NO: 8257 - RNA, 22 nt, Human herpesvirus 1
uacucuggguucccuagguucu

SEQ ID NO: 8258 - RNA, 22 nt, Human herpesvirus 1
acccggggcucccggggaacac

SEQ ID NO: 8259 - RNA, 22 nt, Human herpesvirus 1
ccucgcgccccagcgccacgua

SEQ ID NO: 8260 - RNA, 22 nt, Human herpesvirus 1
caggccccagcgcgcgcaggcg

SEQ ID NO: 8261 - RNA, 22 nt, Human herpesvirus 1
ggaggaggccgucccgccggag

SEQ ID NO: 8262 - RNA, 18 nt, Human herpesvirus 1
uuuccucauggccccuuu

SEQ ID NO: 8263 - RNA, 22 nt, Human herpesvirus 1
acagccgcccccuggucagcuu

SEQ ID NO: 8264 - RNA, 22 nt, Human herpesvirus 1
ggcccguuggucgaggggcagc

SEQ ID NO: 8265 - RNA, 22 nt, Human herpesvirus 1
uccguccgcacgcgcgccauua

SEQ ID NO: 8266 - RNA, 22 nt, Human herpesvirus 1
caggccgagcgcgggcugacgc

SEQ ID NO: 8267 - RNA, 22 nt, Human herpesvirus 1
cgacgaccacagagaaggugcg

SEQ ID NO: 8268 - RNA, 20 nt, Human herpesvirus 1
cguacaccgucuuggcguug

SEQ ID NO: 8269 - RNA, 22 nt, Human herpesvirus 1
aggccacagcaccacgugggua

SEQ ID NO: 8270 - RNA, 21 nt, Human herpesvirus 1
uauuuuccucgucugcggccu

SEQ ID NO: 8271 - RNA, 22 nt, Human herpesvirus 1
aacccgggcaccacgugucccu

SEQ ID NO: 8272 - RNA, 22 nt, Human herpesvirus 1
cgccacgugggucccgggcacg

SEQ ID NO: 8273 - RNA, 22 nt, Human herpesvirus 1
ucgcucggcggggacgucuacc

SEQ ID NO: 8274 - RNA, 22 nt, Human herpesvirus 1
cgacguccccaccgaggcccuu

SEQ ID NO: 8275 - RNA, 22 nt, Human herpesvirus 1
ucgggaaaagauucagcgggcg

SEQ ID NO: 8276 - RNA, 12 nt, Human herpesvirus 1
ccccucccccga

SEQ ID NO: 8277 - RNA, 22 nt, Human herpesvirus 1
ugggguuggugugcaaaggcac

SEQ ID NO: 8278 - RNA, 22 nt, Human herpesvirus 1
ccaggugggccgguacuccauc

SEQ ID NO: 8279 - RNA, 22 nt, Human herpesvirus 1
cggggacccgggggacggccgg

SEQ ID NO: 8280 - RNA, 20 nt, Human herpesvirus 1
ugccguccgccgcgcccucg

SEQ ID NO: 8281 - RNA, 22 nt, Human herpesvirus 1
cccggagaggcguccauugaca

SEQ ID NO: 8282 - RNA, 21 nt, Human herpesvirus 1
uagcgauauacguuuauuggg

SEQ ID NO: 8283 - RNA, 22 nt, Human herpesvirus 1
ggggcauccuccgugucggacu

SEQ ID NO: 8284 - RNA, 20 nt, Human herpesvirus 1
ugguccgaaccggcggccuc

SEQ ID NO: 8285 - RNA, 22 nt, Human herpesvirus 1
ccgggccgccgcggcgcaggcc

SEQ ID NO: 8286 - RNA, 22 nt, Human herpesvirus 1
ccgugucgcgccggcccgccga

SEQ ID NO: 8287 - RNA, 22 nt, Human herpesvirus 1
ggacccccaggcucgcccgggc

SEQ ID NO: 8288 - RNA, 22 nt, Human herpesvirus 1
cuuguuugucuggcggauccgg

SEQ ID NO: 8289 - RNA, 22 nt, Human herpesvirus 1
ugguccccggggacguggcgcu

SEQ ID NO: 8290 - RNA, 21 nt, Human herpesvirus 1
cuuccggaucucgggcgccgc

SEQ ID NO: 8291 - RNA, 22 nt, Human herpesvirus 1
uccgggggcggcgugugggggu

SEQ ID NO: 8292 - RNA, 22 nt, Human herpesvirus 1
cucggucaccccaauccccccc

SEQ ID NO: 8293 - RNA, 22 nt, Human herpesvirus 1
cgugacguuugauacccuguuu

SEQ ID NO: 8294 - RNA, 18 nt, Human herpesvirus 1
gggcgucgccagcucacg

SEQ ID NO: 8295 - RNA, 22 nt, Human herpesvirus 1
ggucccggcgcuggcgguaagu

SEQ ID NO: 8296 - RNA, 21 nt, Human herpesvirus 1
cagaaacgccgcgcccgggcc

SEQ ID NO: 8297 - RNA, 22 nt, Human herpesvirus 1
ccaugcggcguuggaugagcuc

SEQ ID NO: 8298 - RNA, 20 nt, Human herpesvirus 1
aacuccuccaccgcccaugg

SEQ ID NO: 8299 - RNA, 22 nt, Human herpesvirus 1
ccgccucccccgagucuucgga

SEQ ID NO: 8300 - RNA, 20 nt, Human herpesvirus 1
ccgaggcacggaugagcggc

SEQ ID NO: 8301 - RNA, 22 nt, Human herpesvirus 1
ggccgcgcccagggccgucacc

SEQ ID NO: 8302 - RNA, 20 nt, Human herpesvirus 1
cgcggugcgcccgcacggcc

SEQ ID NO: 8303 - RNA, 22 nt, Human herpesvirus 1
ucugcgugucgaucuggcccgg

SEQ ID NO: 8304 - RNA, 22 nt, Human herpesvirus 1
gguggucguccucgaaccagac

SEQ ID NO: 8305 - RNA, 22 nt, Human herpesvirus 1
cgggccccggccuccaggcccg

SEQ ID NO: 8306 - RNA, 22 nt, Human herpesvirus 1
gcggaccacgcggccgcagccu

SEQ ID NO: 8307 - RNA, 22 nt, Human herpesvirus 1
uacaccgcagcgcccagcacgg

SEQ ID NO: 8308 - RNA, 22 nt, Human herpesvirus 1
cagccggcgcgcugcggugucg

SEQ ID NO: 8309 - RNA, 22 nt, Human herpesvirus 1
uguugggccgccacgcgcggcu

SEQ ID NO: 8310 - RNA, 22 nt, Human herpesvirus 1
uggcuccgggccaaccaagaga

SEQ ID NO: 8311 - RNA, 22 nt, Human herpesvirus 1
ucgcccacggcccgagccucua

SEQ ID NO: 8312 - RNA, 21 nt, Human herpesvirus 1
aauccucgggccgcaucgacc

SEQ ID NO: 8313 - RNA, 22 nt, Human herpesvirus 1
ggggccccaggcuuuucacggu

SEQ ID NO: 8314 - RNA, 13 nt, Human herpesvirus 1
cgacggccgcccc

SEQ ID NO: 8315 - RNA, 22 nt, Human herpesvirus 1
cgccacccaccgcacccccgcg

SEQ ID NO: 8316 - RNA, 19 nt, Human herpesvirus 1
cauggaccuggugcuggcg

SEQ ID NO: 8317 - RNA, 22 nt, Human herpesvirus 1
ugucccuuuccgaugcgauccc

SEQ ID NO: 8318 - RNA, 20 nt, Human herpesvirus 1
gggcgucgcgaugccgacgc

SEQ ID NO: 8319 - RNA, 22 nt, Human herpesvirus 1
ugucccuuuccgaugcgauccc

SEQ ID NO: 8320 - RNA, 20 nt, Human herpesvirus 1
gggcgucgcgaugccgacgc

SEQ ID NO: 8321 - RNA, 22 nt, Human herpesvirus 1
uccccucugcucuuuccccgug

SEQ ID NO: 8322 - RNA, 22 nt, Human herpesvirus 1
cugggggcguggcugccgggag

SEQ ID NO: 8323 - RNA, 22 nt, Human herpesvirus 1
ggguccuugaccccacuuccgg

SEQ ID NO: 8324 - RNA, 20 nt, Human herpesvirus 1
cccguggugguguucgacuu

SEQ ID NO: 8325 - RNA, 22 nt, Human herpesvirus 1
gauucgugcgccacgucggcca

SEQ ID NO: 8326 - RNA, 22 nt, Human herpesvirus 1
ccggcggauggucggcaggaau

SEQ ID NO: 8327 - RNA, 21 nt, Human herpesvirus 1
cccgccgucccguuggucccg

SEQ ID NO: 8328 - RNA, 21 nt, Human herpesvirus 1
cccgccgucccguuggucccg

SEQ ID NO: 8329 - RNA, 22 nt, Human herpesvirus 1
ccccugggccagacgaccgcgg

SEQ ID NO: 8330 - RNA, 22 nt, Human herpesvirus 1
guggaucugucucgccaggggc

SEQ ID NO: 8331 - RNA, 22 nt, Human herpesvirus 1
gggcggugguggacaggucgua

SEQ ID NO: 8332 - RNA, 22 nt, Human herpesvirus 1
ugaccagguccuccgggugccc

SEQ ID NO: 8333 - RNA, 22 nt, Human herpesvirus 1
ggcgggagccgccgccgccgcu

SEQ ID NO: 8334 - RNA, 22 nt, Human herpesvirus 1
ugguguugguguuacugcugcc

SEQ ID NO: 8335 - RNA, 22 nt, Human herpesvirus 1
ggcgggagccgccgccgccgcu

SEQ ID NO: 8336 - RNA, 22 nt, Human herpesvirus 1
ugguguugguguuacugcugcc

SEQ ID NO: 8337 - RNA, 22 nt, Human herpesvirus 1
ccgcgcuucgacgggagaggau

SEQ ID NO: 8338 - RNA, 22 nt, Human herpesvirus 1
ccauuucaacagacgcggcggg

SEQ ID NO: 8339 - RNA, 22 nt, Human herpesvirus 1
agcgugagcauggcgggcccgu

SEQ ID NO: 8340 - RNA, 22 nt, Human herpesvirus 1
gcgcccguugugaaacauggcg

SEQ ID NO: 8341 - RNA, 22 nt, Human herpesvirus 1
aggccagccgcugcguccgcga

SEQ ID NO: 8342 - RNA, 22 nt, Human herpesvirus 1
cguccguagucgggaagacaac

SEQ ID NO: 8343 - RNA, 22 nt, Human herpesvirus 1
gcgucgauguguagcgcgaggg

SEQ ID NO: 8344 - RNA, 22 nt, Human herpesvirus 1
cacgaagacaccccagacaagg

SEQ ID NO: 8345 - RNA, 22 nt, Human herpesvirus 1
gggccucgguggggacgucggc

SEQ ID NO: 8346 - RNA, 22 nt, Human herpesvirus 1
uagacguccccgccgagcgacg

SEQ ID NO: 8347 - RNA, 22 nt, Human herpesvirus 1
ucagggcggcggucagcgacgu

SEQ ID NO: 8348 - RNA, 19 nt, Human herpesvirus 1
cgcgccuagccaaccugug

SEQ ID NO: 8349 - RNA, 22 nt, Human herpesvirus 1
acccgcccccgcgccucgcccg

SEQ ID NO: 8350 - RNA, 22 nt, Human herpesvirus 1
ggcgauggggugggguucaugg

SEQ ID NO: 8351 - RNA, 22 nt, Human herpesvirus 1
ucgggggaggggcgggggcucg

SEQ ID NO: 8352 - RNA, 22 nt, Human herpesvirus 1
gccgcgcccgcugaaucuuuuc

SEQ ID NO: 8353 - RNA, 22 nt, Human herpesvirus 1
ugggugggcgagguggccgggg

SEQ ID NO: 8354 - RNA, 22 nt, Human herpesvirus 1
cggacgacaccuugcgacaaaa

SEQ ID NO: 8355 - RNA, 22 nt, Human herpesvirus 1
ugcagcaucuggucggccgugc

SEQ ID NO: 8356 - RNA, 22 nt, Human herpesvirus 1
gaggacggccuggacguugcga

SEQ ID NO: 8357 - RNA, 22 nt, Human herpesvirus 1
gccccggagcgaguacccgccg

SEQ ID NO: 8358 - RNA, 12 nt, Human herpesvirus 1
gaggugaggggc

SEQ ID NO: 8359 - RNA, 22 nt, Human herpesvirus 1
gccccggagcgaguacccgccg

SEQ ID NO: 8360 - RNA, 12 nt, Human herpesvirus 1
gaggugaggggc

SEQ ID NO: 8361 - RNA, 22 nt, Human herpesvirus 1
gaguuugacaggcaagcaugug

SEQ ID NO: 8362 - RNA, 21 nt, Human herpesvirus 1
uagugcuugccugucuaacuc

SEQ ID NO: 8363 - RNA, 22 nt, Human herpesvirus 1
uggagcucugggguccgagcgg

SEQ ID NO: 8364 - RNA, 22 nt, Human herpesvirus 1
cgcgucacccccccauuccagc

SEQ ID NO: 8365 - RNA, 22 nt, Human herpesvirus 1
ccugcuaggcuuuuuggcccac

SEQ ID NO: 8366 - RNA, 20 nt, Human herpesvirus 1
ccggguuggccgcccgcggg

SEQ ID NO: 8367 - RNA, 22 nt, Human herpesvirus 1
agguacggggcggcccgugcgg

SEQ ID NO: 8368 - RNA, 22 nt, Human herpesvirus 1
gaccacgggcugucauuccucg

SEQ ID NO: 8369 - RNA, 22 nt, Human herpesvirus 1
ggcgguacugauccgcgccugu

SEQ ID NO: 8370 - RNA, 12 nt, Human herpesvirus 1
agcggacccgcc

SEQ ID NO: 8371 - RNA, 22 nt, Human herpesvirus 1
gcgcgggagucguggcuuuggg

SEQ ID NO: 8372 - RNA, 22 nt, Human herpesvirus 1
ucggaggcggcgcaacccgacg

SEQ ID NO: 8373 - RNA, 22 nt, Human herpesvirus 1
ucuucaucgccgacagcagcau

SEQ ID NO: 8374 - RNA, 22 nt, Human herpesvirus 1
agguccugaaauucggcagacu

SEQ ID NO: 8375 - RNA, 22 nt, Human herpesvirus 1
uucccgcccggucucgucguug

SEQ ID NO: 8376 - RNA, 22 nt, Human herpesvirus 1
ccacgcgagccgggcgucaugg

SEQ ID NO: 8377 - RNA, 22 nt, Human herpesvirus 1
ugagguccaaaaucaccuccca

SEQ ID NO: 8378 - RNA, 15 nt, Human herpesvirus 1
cugcagguccuccag

SEQ ID NO: 8379 - RNA, 22 nt, Human herpesvirus 1
cggcguggggcagguaccgccg

SEQ ID NO: 8380 - RNA, 22 nt, Human herpesvirus 1
gcguccagccgcaccugcgccu

SEQ ID NO: 8381 - RNA, 22 nt, Human herpesvirus 1
cgccguuccguuuuccggaaua

SEQ ID NO: 8382 - RNA, 21 nt, Human herpesvirus 1
uugggggagacgguuucggug

SEQ ID NO: 8383 - RNA, 22 nt, Human herpesvirus 1
uguccuuuugucaaucgguccg

SEQ ID NO: 8384 - RNA, 16 nt, Human herpesvirus 1
ggcacgacgacggacg

SEQ ID NO: 8385 - RNA, 22 nt, Human herpesvirus 1
uccgaguucccccggcacgccu

SEQ ID NO: 8386 - RNA, 22 nt, Human herpesvirus 1
aggcggcgaacgggggcccugc

SEQ ID NO: 8387 - RNA, 22 nt, Human herpesvirus 1
aguuagacaggcaagcacuacu

SEQ ID NO: 8388 - RNA, 15 nt, Human herpesvirus 1
cuugccugucaaacu

SEQ ID NO: 8389 - RNA, 22 nt, Human herpesvirus 1
gagccguaccgggccaaugggu

SEQ ID NO: 8390 - RNA, 22 nt, Human herpesvirus 1
cacacgggcccgggggguuuag

SEQ ID NO: 8391 - RNA, 22 nt, Human herpesvirus 1
acuuacuggcggguguuggggg

SEQ ID NO: 8392 - RNA, 22 nt, Human herpesvirus 1
cacacaacaccgccucgaccag

SEQ ID NO: 8393 - RNA, 22 nt, Human herpesvirus 1
uagcauaucacauaccccguuc

SEQ ID NO: 8394 - RNA, 20 nt, Human herpesvirus 1
gggcggggguggauacgcug

SEQ ID NO: 8395 - RNA, 22 nt, Human herpesvirus 1
uugacgaacaugaagggcugga

SEQ ID NO: 8396 - RNA, 18 nt, Human herpesvirus 1
agcucuccaggucgcaac

SEQ ID NO: 8397 - RNA, 22 nt, Human herpesvirus 1
ucgaagcccucggccagcgccu

SEQ ID NO: 8398 - RNA, 16 nt, Human herpesvirus 1
gcggccaggcacucga

SEQ ID NO: 8399 - RNA, 22 nt, Human herpesvirus 1
ucgaggugugcgaggugggccu

SEQ ID NO: 8400 - RNA, 21 nt, Human herpesvirus 1
gcacccgcaacgagucacggc

SEQ ID NO: 8401 - RNA, 22 nt, Human herpesvirus 1
gcuuaggagcugccgggagacc

SEQ ID NO: 8402 - RNA, 21 nt, Human herpesvirus 1
ggcgucccaguggguucaggc

SEQ ID NO: 8403 - RNA, 22 nt, Human herpesvirus 1
agcgggcuggggcucgaggucg

SEQ ID NO: 8404 - RNA, 22 nt, Human herpesvirus 1
gaacgcccucgagucgccgugg

SEQ ID NO: 8405 - RNA, 22 nt, Human herpesvirus 1
cgccagcacggugccgcugcgg

SEQ ID NO: 8406 - RNA, 20 nt, Human herpesvirus 1
ccagcgaaucccgggcggcg

SEQ ID NO: 8407 - RNA, 22 nt, Human herpesvirus 1
cgccagcacggugccgcugcgg

SEQ ID NO: 8408 - RNA, 20 nt, Human herpesvirus 1
ccagcgaaucccgggcggcg

SEQ ID NO: 8409 - RNA, 22 nt, Human herpesvirus 1
ugcaacgcacgucgggguugcc

SEQ ID NO: 8410 - RNA, 21 nt, Human herpesvirus 1
ggcccccaccgcgugcggcac

SEQ ID NO: 8411 - RNA, 22 nt, Human herpesvirus 1
gccgaacagcgcgguggggggu

SEQ ID NO: 8412 - RNA, 22 nt, Human herpesvirus 1
caccccgcguagcugcggacgg

SEQ ID NO: 8413 - RNA, 22 nt, Human herpesvirus 1
cauaaaccauuccccauggggg

SEQ ID NO: 8414 - RNA, 19 nt, Human herpesvirus 1
cacggggcccguggcuaug

SEQ ID NO: 8415 - RNA, 22 nt, Human herpesvirus 1
gacgaaaaaagccuggugcuca

SEQ ID NO: 8416 - RNA, 16 nt, Human herpesvirus 1
cuucaggcccagcguc

SEQ ID NO: 8417 - RNA, 22 nt, Human herpesvirus 1
cggaaaccaggcccccucugcc

SEQ ID NO: 8418 - RNA, 21 nt, Human herpesvirus 1
ggcaccgagacgcgcgucucg

SEQ ID NO: 8419 - RNA, 22 nt, Human herpesvirus 1
ugcccgcccaggcggccguguc

SEQ ID NO: 8420 - RNA, 22 nt, Human herpesvirus 1
uggccagggccgccagcaggca

SEQ ID NO: 8421 - RNA, 22 nt, Human herpesvirus 1
ugcccgcccaggcggccguguc

SEQ ID NO: 8422 - RNA, 22 nt, Human herpesvirus 1
uggccagggccgccagcaggca

SEQ ID NO: 8423 - RNA, 22 nt, Human herpesvirus 1
gaccacagucacgcaccuggcc

SEQ ID NO: 8424 - RNA, 20 nt, Human herpesvirus 1
guuggggaaggugacggguc

SEQ ID NO: 8425 - RNA, 22 nt, Human herpesvirus 1
ucguacacgcuccuaaccauug

SEQ ID NO: 8426 - RNA, 19 nt, Human herpesvirus 1
ggcuguucagggacggcga

SEQ ID NO: 8427 - RNA, 22 nt, Human herpesvirus 1
gcggacucggucggcaccuaug

SEQ ID NO: 8428 - RNA, 20 nt, Human herpesvirus 1
cgcgggcccccggccgccgc

SEQ ID NO: 8429 - RNA, 22 nt, Human herpesvirus 1
gcugauggcguacaggccgggc

SEQ ID NO: 8430 - RNA, 22 nt, Human herpesvirus 1
cugaaacacgucgugcgccucc

SEQ ID NO: 8431 - RNA, 22 nt, Human herpesvirus 1
uccacgccgacgccaacgccgc

SEQ ID NO: 8432 - RNA, 22 nt, Human herpesvirus 1
cgcguucuucgaggggaugggc

SEQ ID NO: 8433 - RNA, 22 nt, Human herpesvirus 1
accaaucgcccgccggcugccg

SEQ ID NO: 8434 - RNA, 22 nt, Human herpesvirus 1
ugcugcaacuuaccuccgggau

SEQ ID NO: 8435 - RNA, 22 nt, Human herpesvirus 1
uccggacgucuucggaggcccc

SEQ ID NO: 8436 - RNA, 22 nt, Human herpesvirus 1
ggccuccgacggugcguuuagg

SEQ ID NO: 8437 - RNA, 22 nt, Human herpesvirus 1
gccacggcggccgccgcgugcg

SEQ ID NO: 8438 - RNA, 20 nt, Human herpesvirus 1
aagcggccggccgccauggc

SEQ ID NO: 8439 - RNA, 22 nt, Human herpesvirus 1
gccacggcggccgccgcgugcg

SEQ ID NO: 8440 - RNA, 20 nt, Human herpesvirus 1
aagcggccggccgccauggc

SEQ ID NO: 8441 - RNA, 22 nt, Human herpesvirus 1
agugcucgcacuucgcccuaau

SEQ ID NO: 8442 - RNA, 20 nt, Human herpesvirus 1
ugggacgaagugcgaacgcu

SEQ ID NO: 8443 - RNA, 22 nt, Human herpesvirus 1
agugcucgcacuucgcccuaau

SEQ ID NO: 8444 - RNA, 20 nt, Human herpesvirus 1
ugggacgaagugcgaacgcu

SEQ ID NO: 8445 - RNA, 22 nt, Human herpesvirus 1
uccucgagacggccgccagcgc

SEQ ID NO: 8446 - RNA, 22 nt, Human herpesvirus 1
gccgcgggccgccgcucucccg

SEQ ID NO: 8447 - RNA, 22 nt, Human herpesvirus 1
ccacgcccgccgcgcgcgcgca

SEQ ID NO: 8448 - RNA, 22 nt, Human herpesvirus 1
cgcgcgcgcgcgcccgcggggg

SEQ ID NO: 8449 - RNA, 22 nt, Human herpesvirus 1
uggcggcccggcccggggcccc

SEQ ID NO: 8450 - RNA, 20 nt, Human herpesvirus 1
gccccggcccggggccccac

SEQ ID NO: 8451 - RNA, 22 nt, Human herpesvirus 1
cccgccguggcccgggacgacg

SEQ ID NO: 8452 - RNA, 21 nt, Human herpesvirus 1
ggacccccggccacgucuggg

SEQ ID NO: 8453 - RNA, 22 nt, Human herpesvirus 1
uaacggcaaucguguacgucgu

SEQ ID NO: 8454 - RNA, 22 nt, Human herpesvirus 1
gcagcgucaucggcgguaacgc

SEQ ID NO: 8455 - RNA, 22 nt, Human herpesvirus 1
gggccguccgccuccugcacgc

SEQ ID NO: 8456 - RNA, 19 nt, Human herpesvirus 1
gugucuggcggcacagcuc

SEQ ID NO: 8457 - RNA, 22 nt, Human herpesvirus 1
ucgcgccgugcugacaaacgcc

SEQ ID NO: 8458 - RNA, 22 nt, Human herpesvirus 1
gucuuccugugcacggccgacg

SEQ ID NO: 8459 - RNA, 22 nt, Human herpesvirus 1
gccaacacgaguacaugcaucu

SEQ ID NO: 8460 - RNA, 22 nt, Human herpesvirus 1
auuccaugcuauucgugcagcg

SEQ ID NO: 8461 - RNA, 22 nt, Human herpesvirus 1
cccccgagucggacccggaggc

SEQ ID NO: 8462 - RNA, 22 nt, Human herpesvirus 1
cuccgaagggacggcuccgggg

SEQ ID NO: 8463 - RNA, 22 nt, Human herpesvirus 1
agcgcgcgcgagugggccaaaa

SEQ ID NO: 8464 - RNA, 20 nt, Human herpesvirus 1
gagaggcagaccgcgccguu

SEQ ID NO: 8465 - RNA, 22 nt, Human herpesvirus 1
ggggcgcguuaaaaaccucacc

SEQ ID NO: 8466 - RNA, 21 nt, Human herpesvirus 1
ugggguuguuggacgcccacc

SEQ ID NO: 8467 - RNA, 22 nt, Human herpesvirus 1
uccgccgucgcagccguauccc

SEQ ID NO: 8468 - RNA, 20 nt, Human herpesvirus 1
gcaucggcgauggcgucgga

SEQ ID NO: 8469 - RNA, 22 nt, Human herpesvirus 1
uacuucaccuucggugggggcu

SEQ ID NO: 8470 - RNA, 22 nt, Human herpesvirus 1
cguacucccaccagcugagccg

SEQ ID NO: 8471 - RNA, 22 nt, Human herpesvirus 1
ugccgcucgaucguuguuuucg

SEQ ID NO: 8472 - RNA, 20 nt, Human herpesvirus 1
cguacaacauccgcgcuagc

SEQ ID NO: 8473 - RNA, 22 nt, Human herpesvirus 1
uccgcgcccaccuuaaguugcc

SEQ ID NO: 8474 - RNA, 20 nt, Human herpesvirus 1
gcgcuccagguacugcugga

SEQ ID NO: 8475 - RNA, 22 nt, Human herpesvirus 1
ccucuggcgacagcccgccguc

SEQ ID NO: 8476 - RNA, 22 nt, Human herpesvirus 1
cgcgccgggcgcaggaacaaag

SEQ ID NO: 8477 - RNA, 22 nt, Human herpesvirus 1
gcaccugggggugugcgacgag

SEQ ID NO: 8478 - RNA, 21 nt, Human herpesvirus 1
ugucgcacgaggacaacgugc

SEQ ID NO: 8479 - RNA, 22 nt, Human herpesvirus 1
ucgccaucgcaccaauacacaa

SEQ ID NO: 8480 - RNA, 22 nt, Human herpesvirus 1
uguggaugacggugcugacgac

SEQ ID NO: 8481 - RNA, 22 nt, Human herpesvirus 1
gcgacacucacagaucguugac

SEQ ID NO: 8482 - RNA, 22 nt, Human herpesvirus 1
uaggaggugcugcgacacucga

SEQ ID NO: 8483 - RNA, 22 nt, Human herpesvirus 1
ugggcccgacagaccuccccgc

SEQ ID NO: 8484 - RNA, 21 nt, Human herpesvirus 1
ugucgccucccaacccccuaa

SEQ ID NO: 8485 - RNA, 22 nt, Human herpesvirus 1
cgcgccagcguccggcagcugc

SEQ ID NO: 8486 - RNA, 21 nt, Human herpesvirus 1
acaugcgcggacgcgaucgcg

SEQ ID NO: 8487 - RNA, 22 nt, Human herpesvirus 1
agcuccaggccccgggcguccc

SEQ ID NO: 8488 - RNA, 14 nt, Human herpesvirus 1
gccaggggcaaguu

SEQ ID NO: 8489 - RNA, 22 nt, Human herpesvirus 1
ccacgcccgccgcgcgcgcgca

SEQ ID NO: 8490 - RNA, 22 nt, Human herpesvirus 1
cgcgcgcgcgcgcccgcggggg

SEQ ID NO: 8491 - RNA, 22 nt, Human herpesvirus 1
cccuccccacgcgcccccaacc

SEQ ID NO: 8492 - RNA, 18 nt, Human herpesvirus 1
uuaggggcggugaugggg

SEQ ID NO: 8493 - RNA, 22 nt, Human herpesvirus 1
uggcccgggccgaccaccagaa

SEQ ID NO: 8494 - RNA, 22 nt, Human herpesvirus 1
uuggcuuccggaccacuuuucg

SEQ ID NO: 8495 - RNA, 22 nt, Human herpesvirus 1
gcagcgggagggcguacuuaca

SEQ ID NO: 8496 - RNA, 18 nt, Human herpesvirus 1
ugcuccaggauaaacugu

SEQ ID NO: 8497 - RNA, 22 nt, Human herpesvirus 1
cccccgggggcgcgcagaugug

SEQ ID NO: 8498 - RNA, 20 nt, Human herpesvirus 1
ccggcugccguguagugggg

SEQ ID NO: 8499 - RNA, 22 nt, Human herpesvirus 1
cgcacguggugccguuugcugc

SEQ ID NO: 8500 - RNA, 20 nt, Human herpesvirus 1
accuggggcaugcaccugcg

SEQ ID NO: 8501 - RNA, 22 nt, Human herpesvirus 1
acaccugugaaggcugggugug

SEQ ID NO: 8502 - RNA, 20 nt, Human herpesvirus 1
ucgcgcacccgccgcugugu

SEQ ID NO: 8503 - RNA, 22 nt, Human herpesvirus 1
ugcuggccgcgggguugggguc

SEQ ID NO: 8504 - RNA, 22 nt, Human herpesvirus 1
ccgaagaugcguggcuaggcgc

SEQ ID NO: 8505 - RNA, 22 nt, Human herpesvirus 1
cgccgccgucucccgggggagg

SEQ ID NO: 8506 - RNA, 22 nt, Human herpesvirus 1
uccaaaagucccgggggaacuc

SEQ ID NO: 8507 - RNA, 22 nt, Human herpesvirus 1
cgccguggucggggugcgccgc

SEQ ID NO: 8508 - RNA, 21 nt, Human herpesvirus 1
cacgaccgcuucggccaggcg

SEQ ID NO: 8509 - RNA, 22 nt, Human herpesvirus 1
uguaguguagggcgggguugau

SEQ ID NO: 8510 - RNA, 22 nt, Human herpesvirus 1
gggcugcauagcuugcggaugc

SEQ ID NO: 8511 - RNA, 22 nt, Human herpesvirus 1
gcccgcccgggccgccgagcgg

SEQ ID NO: 8512 - RNA, 21 nt, Human herpesvirus 1
cucuccggaggcccggggggc

SEQ ID NO: 8513 - RNA, 22 nt, Human herpesvirus 1
caucgggccagauucacgcuuc

SEQ ID NO: 8514 - RNA, 20 nt, Human herpesvirus 1
gaucgcuuggaggccggaug

SEQ ID NO: 8515 - RNA, 22 nt, Human herpesvirus 1
ugugcgucgcguuguaccugcg

SEQ ID NO: 8516 - RNA, 21 nt, Human herpesvirus 1
gguccauggcgucgcgggcgu

SEQ ID NO: 8517 - RNA, 22 nt, Human herpesvirus 1
agcggguccggacggggcccgg

SEQ ID NO: 8518 - RNA, 22 nt, Human herpesvirus 1
ggccccucgucccgggccguac

SEQ ID NO: 8519 - RNA, 22 nt, Human herpesvirus 1
cggugagcuuguagccgauccc

SEQ ID NO: 8520 - RNA, 21 nt, Human herpesvirus 1
gagugggugacgacguagcug

SEQ ID NO: 8521 - RNA, 22 nt, Human herpesvirus 1
cggcgccgauuuccggcccggc

SEQ ID NO: 8522 - RNA, 22 nt, Human herpesvirus 1
cggggccgguccagaucgcggu

SEQ ID NO: 8523 - RNA, 22 nt, Human herpesvirus 1
ccuggccuggcccccgaugauc

SEQ ID NO: 8524 - RNA, 22 nt, Human herpesvirus 1
gaaucggccagaaacaaaucgg

SEQ ID NO: 8525 - RNA, 22 nt, Human herpesvirus 1
cggcgcgagccgggccgacgac

SEQ ID NO: 8526 - RNA, 22 nt, Human herpesvirus 1
ucggggccagcuccaucaggcc

SEQ ID NO: 8527 - RNA, 22 nt, Human herpesvirus 1
cggggcgcuggagauaacggcc

SEQ ID NO: 8528 - RNA, 20 nt, Human herpesvirus 1
gaccggggcuggguaucccg

SEQ ID NO: 8529 - RNA, 22 nt, Human herpesvirus 1
agucuucggggcccggcccauu

SEQ ID NO: 8530 - RNA, 22 nt, Human herpesvirus 1
aaugggccgggccgcccacuuc

SEQ ID NO: 8531 - RNA, 22 nt, Human herpesvirus 1
agucuucggggcccggcccauu

SEQ ID NO: 8532 - RNA, 22 nt, Human herpesvirus 1
aaugggccgggccgcccacuuc

SEQ ID NO: 8533 - RNA, 22 nt, Human herpesvirus 1
uccugaccgcggguuccgaguu

SEQ ID NO: 8534 - RNA, 22 nt, Human herpesvirus 1
ccugggacugugcgguugggac

SEQ ID NO: 8535 - RNA, 22 nt, Human herpesvirus 1
gggcgggccugcgccgcggcgg

SEQ ID NO: 8536 - RNA, 20 nt, Human herpesvirus 1
ggcugggcgggggcgggcuc

SEQ ID NO: 8537 - RNA, 22 nt, Human herpesvirus 1
gggcgggccugcgccgcggcgg

SEQ ID NO: 8538 - RNA, 20 nt, Human herpesvirus 1
ggcugggcgggggcgggcuc

SEQ ID NO: 8539 - RNA, 22 nt, Human herpesvirus 1
gcgggucaaacaugagggccgg

SEQ ID NO: 8540 - RNA, 20 nt, Human herpesvirus 1
gggaacagcgggugguccgu

SEQ ID NO: 8541 - RNA, 22 nt, Human herpesvirus 1
gcgggucaaacaugagggccgg

SEQ ID NO: 8542 - RNA, 20 nt, Human herpesvirus 1
gggaacagcgggugguccgu

SEQ ID NO: 8543 - RNA, 22 nt, Human herpesvirus 1
ugcgugucuguucuugcgugug

SEQ ID NO: 8544 - RNA, 21 nt, Human herpesvirus 1
uauguggggucccgggggcgg

SEQ ID NO: 8545 - RNA, 22 nt, Human herpesvirus 1
ugcgugucuguucuugcgugug

SEQ ID NO: 8546 - RNA, 21 nt, Human herpesvirus 1
uauguggggucccgggggcgg

SEQ ID NO: 8547 - RNA, 22 nt, Human herpesvirus 1
ugugugggaagaaagaaaaggg

SEQ ID NO: 8548 - RNA, 22 nt, Human herpesvirus 1
uuccucuuuccuuucccgugac

SEQ ID NO: 8549 - RNA, 22 nt, Human herpesvirus 1
uggggcggcggguagccuucgc

SEQ ID NO: 8550 - RNA, 22 nt, Human herpesvirus 1
ugcgccggccccgucgcucccg

SEQ ID NO: 8551 - RNA, 22 nt, Human herpesvirus 1
ggcacacacagauccgccgcgc

SEQ ID NO: 8552 - RNA, 22 nt, Human herpesvirus 1
uagaggcgaggggggcuggguu

SEQ ID NO: 8553 - RNA, 22 nt, Human herpesvirus 1
ucagggccgagaaggcggcgua

SEQ ID NO: 8554 - RNA, 22 nt, Human herpesvirus 1
augcuguucauggucccgaaga

SEQ ID NO: 8555 - RNA, 22 nt, Human herpesvirus 1
ugguuuuuggauggccugggca

SEQ ID NO: 8556 - RNA, 22 nt, Human herpesvirus 1
uacuggcgcgacacgaacaccg

SEQ ID NO: 8557 - RNA, 22 nt, Human herpesvirus 1
accaucccggagguaaguugca

SEQ ID NO: 8558 - RNA, 22 nt, Human herpesvirus 1
cggcagccggcgggcgauuggu

SEQ ID NO: 8559 - RNA, 22 nt, Human herpesvirus 1
uaggcgaugcgggucccccgag

SEQ ID NO: 8560 - RNA, 22 nt, Human herpesvirus 1
uggguuuggcgcgcguaugcgu

SEQ ID NO: 8561 - RNA, 22 nt, Human herpesvirus 1
ggcgucccggcgcggcgagcgu

SEQ ID NO: 8562 - RNA, 22 nt, Human herpesvirus 1
cggucccgcgucgggucgugga

SEQ ID NO: 8563 - RNA, 22 nt, Human herpesvirus 1
ggcgucccggcgcggcgagcgu

SEQ ID NO: 8564 - RNA, 22 nt, Human herpesvirus 1
cggucccgcgucgggucgugga

SEQ ID NO: 8565 - RNA, 22 nt, Human herpesvirus 1
ggcucagcuggugggaguacgc

SEQ ID NO: 8566 - RNA, 22 nt, Human herpesvirus 1
cguagcccccaccgaaggugaa

SEQ ID NO: 8567 - RNA, 22 nt, Human herpesvirus 1
gccuuggaacggggacggauuu

SEQ ID NO: 8568 - RNA, 13 nt, Human herpesvirus 1
cgcccacccaggc

SEQ ID NO: 8569 - RNA, 22 nt, Human herpesvirus 1
gccguggaggagcucggggggc

SEQ ID NO: 8570 - RNA, 18 nt, Human herpesvirus 1
ccgaccugagcgcccggc

SEQ ID NO: 8571 - RNA, 22 nt, Human herpesvirus 1
ccccuacgcgaucucauacggc

SEQ ID NO: 8572 - RNA, 22 nt, Human herpesvirus 1
cgguacggagauuccgacgggg

SEQ ID NO: 8573 - RNA, 22 nt, Human herpesvirus 1
gccuucgcucuccauccugcau

SEQ ID NO: 8574 - RNA, 17 nt, Human herpesvirus 1
gggugaaugagcugggc

SEQ ID NO: 8575 - RNA, 22 nt, Human herpesvirus 1
acguucgagcucgggguuaacg

SEQ ID NO: 8576 - RNA, 22 nt, Human herpesvirus 1
uguucaccacgaguaccugcgu

SEQ ID NO: 8577 - RNA, 22 nt, Human herpesvirus 1
gcccuggcccagcugguugaug

SEQ ID NO: 8578 - RNA, 18 nt, Human herpesvirus 1
gcccggagcugggcgggc

SEQ ID NO: 8579 - RNA, 22 nt, Human herpesvirus 1
uuauugggaggcgcggguaggc

SEQ ID NO: 8580 - RNA, 22 nt, Human herpesvirus 1
uacaaugcaaaagccuucgacg

SEQ ID NO: 8581 - RNA, 22 nt, Human herpesvirus 1
ccccuggcgcuauguccggcgg

SEQ ID NO: 8582 - RNA, 20 nt, Human herpesvirus 1
ccggggccuggagcuggggg

SEQ ID NO: 8583 - RNA, 22 nt, Human herpesvirus 1
ggccuucgggacauccagcgac

SEQ ID NO: 8584 - RNA, 16 nt, Human herpesvirus 1
ggcggacaaccuggcc

SEQ ID NO: 8585 - RNA, 22 nt, Human herpesvirus 1
cgccuucuacgcgcgcuaucgc

SEQ ID NO: 8586 - RNA, 20 nt, Human herpesvirus 1
cggggagccguggcccggcg

SEQ ID NO: 8587 - RNA, 22 nt, Human herpesvirus 1
cgucuuucacggcggccggcac

SEQ ID NO: 8588 - RNA, 20 nt, Human herpesvirus 1
cccaggccccgaaccugacg

SEQ ID NO: 8589 - RNA, 22 nt, Human herpesvirus 1
ggaguuuuucucgggggacgcg

SEQ ID NO: 8590 - RNA, 18 nt, Human herpesvirus 1
ccgcgccccccucucuuc

SEQ ID NO: 8591 - RNA, 22 nt, Human herpesvirus 1
gagagcggcuuggugcggagcu

SEQ ID NO: 8592 - RNA, 22 nt, Human herpesvirus 1
cuccgcggaagacccaggccgc

SEQ ID NO: 8593 - RNA, 22 nt, Human herpesvirus 1
caaaucggcggcgcgggccgug

SEQ ID NO: 8594 - RNA, 22 nt, Human herpesvirus 1
cgugugcugcgcugcuggcguu

SEQ ID NO: 8595 - RNA, 22 nt, Human herpesvirus 1
gauaccucgagacccggucgau

SEQ ID NO: 8596 - RNA, 22 nt, Human herpesvirus 1
ucgacuggucgguuugaaaggc

SEQ ID NO: 8597 - RNA, 22 nt, Human herpesvirus 1
gccggccacgaacgacgggagc

SEQ ID NO: 8598 - RNA, 22 nt, Human herpesvirus 1
accgggagcgggagucgcagag

SEQ ID NO: 8599 - RNA, 22 nt, Human herpesvirus 1
cacagcgcuuccgugucccccc

SEQ ID NO: 8600 - RNA, 21 nt, Human herpesvirus 1
ugggggcccgcgagcguggug

SEQ ID NO: 8601 - RNA, 22 nt, Human herpesvirus 1
cgcagcacauccuccacggagg

SEQ ID NO: 8602 - RNA, 22 nt, Human herpesvirus 1
uauugggauggaggucggugug

SEQ ID NO: 8603 - RNA, 22 nt, Human herpesvirus 1
ucaaaguucacacacccagccu

SEQ ID NO: 8604 - RNA, 20 nt, Human herpesvirus 1
gcuggcggccugcuugcgac

SEQ ID NO: 8605 - RNA, 22 nt, Human herpesvirus 1
gcccgcgcggcgguggccggcc

SEQ ID NO: 8606 - RNA, 22 nt, Human herpesvirus 1
gccgggcagccccggcgggucg

SEQ ID NO: 8607 - RNA, 22 nt, Human herpesvirus 1
gccacgaucacguacgggaucc

SEQ ID NO: 8608 - RNA, 21 nt, Human herpesvirus 1
cgggaccugcgcgcggcgggc

SEQ ID NO: 8609 - RNA, 22 nt, Human herpesvirus 1
gggagcaguaggccuccagggc

SEQ ID NO: 8610 - RNA, 20 nt, Human herpesvirus 1
ccgccguguggcugggcccc

SEQ ID NO: 8611 - RNA, 22 nt, Human herpesvirus 1
gggagcaguaggccuccagggc

SEQ ID NO: 8612 - RNA, 20 nt, Human herpesvirus 1
ccgccguguggcugggcccc

SEQ ID NO: 8613 - RNA, 22 nt, Human herpesvirus 1
cgucgagugccuggccgccugc

SEQ ID NO: 8614 - RNA, 22 nt, Human herpesvirus 1
cgcuggccgagggcuucgacgg

SEQ ID NO: 8615 - RNA, 22 nt, Human herpesvirus 1
uggaaccggccgccauguuggg

SEQ ID NO: 8616 - RNA, 22 nt, Human herpesvirus 1
ucauacacgggagccgggcgcc

SEQ ID NO: 8617 - RNA, 22 nt, Human herpesvirus 1
uggaaccggccgccauguuggg

SEQ ID NO: 8618 - RNA, 22 nt, Human herpesvirus 1
ucauacacgggagccgggcgcc

SEQ ID NO: 8619 - RNA, 22 nt, Human herpesvirus 1
gcuaacccagcucccgccguug

SEQ ID NO: 8620 - RNA, 14 nt, Human herpesvirus 1
gccgggacuggagc

SEQ ID NO: 8621 - RNA, 22 nt, Human herpesvirus 1
agaaacuacuaugggccgugga

SEQ ID NO: 8622 - RNA, 20 nt, Human herpesvirus 1
cggccccuuacacccgucgu

SEQ ID NO: 8623 - RNA, 22 nt, Human herpesvirus 1
agcacgcggcccccuagaaacu

SEQ ID NO: 8624 - RNA, 22 nt, Human herpesvirus 1
gcgucgaugagaugggcugcgc

SEQ ID NO: 8625 - RNA, 22 nt, Human herpesvirus 1
gcgccagaggggcgagguccgu

SEQ ID NO: 8626 - RNA, 22 nt, Human herpesvirus 1
gucggauuaugcccucuacggg

SEQ ID NO: 8627 - RNA, 22 nt, Human herpesvirus 1
gcgaccccgcgcugacggacga

SEQ ID NO: 8628 - RNA, 22 nt, Human herpesvirus 1
cacccugcggcgcggcagcgau

SEQ ID NO: 8629 - RNA, 22 nt, Human herpesvirus 1
cccaccagcgcgccccgccagg

SEQ ID NO: 8630 - RNA, 20 nt, Human herpesvirus 1
cggcugggcgaggccugggg

SEQ ID NO: 8631 - RNA, 22 nt, Human herpesvirus 1
cggacuugccguuaacuaguua

SEQ ID NO: 8632 - RNA, 22 nt, Human herpesvirus 1
cuuuauuauguuacgcccaccc

SEQ ID NO: 8633 - RNA, 22 nt, Human herpesvirus 1
gaaaggggucugcaaccaaagg

SEQ ID NO: 8634 - RNA, 22 nt, Human herpesvirus 1
uuuggaucccgaccccucuucu

SEQ ID NO: 8635 - RNA, 22 nt, Human herpesvirus 1
ugauggacgcggggauggcuau

SEQ ID NO: 8636 - RNA, 22 nt, Human herpesvirus 1
ucaccguuagcgcguaucgcga

SEQ ID NO: 8637 - RNA, 22 nt, Human herpesvirus 1
uggagcgacggcgccccguugc

SEQ ID NO: 8638 - RNA, 21 nt, Human herpesvirus 1
ggccagggcggccccgaacca

SEQ ID NO: 8639 - RNA, 22 nt, Human herpesvirus 1
gggaggacgagguguuucugga

SEQ ID NO: 8640 - RNA, 22 nt, Human herpesvirus 1
uucuaaacccgaacgugagcuc

SEQ ID NO: 8641 - RNA, 22 nt, Human herpesvirus 1
gggaugucuuacuguauaucuu

SEQ ID NO: 8642 - RNA, 18 nt, Human herpesvirus 1
uaauaccaaauaagaccc

SEQ ID NO: 8643 - RNA, 22 nt, Human herpesvirus 1
gccccuggugcugcgcgaggcc

SEQ ID NO: 8644 - RNA, 22 nt, Human herpesvirus 1
ccguucgcccccagcuuuuugg

SEQ ID NO: 8645 - RNA, 22 nt, Human herpesvirus 1
ugcgccgcggcggcgucgcguc

SEQ ID NO: 8646 - RNA, 22 nt, Human herpesvirus 1
gcuggcguuguugauggccacg

SEQ ID NO: 8647 - RNA, 22 nt, Human herpesvirus 1
ggccacaggccagacgggcgcg

SEQ ID NO: 8648 - RNA, 22 nt, Human herpesvirus 1
cgcgccccugcucguggaucuu

SEQ ID NO: 8649 - RNA, 22 nt, Human herpesvirus 1
gcgccgccaugacgggccgcag

SEQ ID NO: 8650 - RNA, 19 nt, Human herpesvirus 1
cgaacauggacguccacgc

SEQ ID NO: 8651 - RNA, 22 nt, Human herpesvirus 1
ccccugcccgacagggccgugc

SEQ ID NO: 8652 - RNA, 22 nt, Human herpesvirus 1
uuuuuggcccuguaugacagcg

SEQ ID NO: 8653 - RNA, 22 nt, Human herpesvirus 1
uccgggggacaaagggccgggu

SEQ ID NO: 8654 - RNA, 17 nt, Human herpesvirus 1
cggcucccccaccugag

SEQ ID NO: 8655 - RNA, 22 nt, Human herpesvirus 1
cgucugguucgaggauaugacc

SEQ ID NO: 8656 - RNA, 22 nt, Human herpesvirus 1
ugucuucccgacuacggacgcc

SEQ ID NO: 8657 - RNA, 22 nt, Human herpesvirus 1
cgccgcccaccccgagcccaga

SEQ ID NO: 8658 - RNA, 20 nt, Human herpesvirus 1
gggcccucggguggggcgcg

SEQ ID NO: 8659 - RNA, 22 nt, Human herpesvirus 1
gcgccccaaccccagccgcauu

SEQ ID NO: 8660 - RNA, 17 nt, Human herpesvirus 1
gcugcggcgggguccgu

SEQ ID NO: 8661 - RNA, 22 nt, Human herpesvirus 1
cgcaacaccugcccgcugugca

SEQ ID NO: 8662 - RNA, 22 nt, Human herpesvirus 1
uaccugauagugggcgugacgc

SEQ ID NO: 8663 - RNA, 22 nt, Human herpesvirus 1
gcccagacgcccuccgaggaga

SEQ ID NO: 8664 - RNA, 20 nt, Human herpesvirus 1
ucgcucucggugccccuggu

SEQ ID NO: 8665 - RNA, 22 nt, Human herpesvirus 1
cgcgccacggccuccgcguucu

SEQ ID NO: 8666 - RNA, 21 nt, Human herpesvirus 1
gacgggguaggccgugcccgu

SEQ ID NO: 8667 - RNA, 22 nt, Human herpesvirus 1
ucccgccaugcgccagggcgcc

SEQ ID NO: 8668 - RNA, 22 nt, Human herpesvirus 1
cgccggugguucgucguauggg

SEQ ID NO: 8669 - RNA, 22 nt, Human herpesvirus 1
cgccguccccuuacaguuccac

SEQ ID NO: 8670 - RNA, 20 nt, Human herpesvirus 1
gggacucacuacccaccgcg

SEQ ID NO: 8671 - RNA, 22 nt, Human herpesvirus 1
ccgcgugaucagggcguacugc

SEQ ID NO: 8672 - RNA, 20 nt, Human herpesvirus 1
cagcucgggcgcccacacgg

SEQ ID NO: 8673 - RNA, 22 nt, Human herpesvirus 1
uccaguuucuguugucgguguu

SEQ ID NO: 8674 - RNA, 19 nt, Human herpesvirus 1
gcccacauccaccguaggg

SEQ ID NO: 8675 - RNA, 22 nt, Human herpesvirus 1
ccgcccgugcgccgucgacggg

SEQ ID NO: 8676 - RNA, 19 nt, Human herpesvirus 1
cgacgacggcgcgcgucgg

SEQ ID NO: 8677 - RNA, 22 nt, Human herpesvirus 1
ucgccauuuuggaugguauggu

SEQ ID NO: 8678 - RNA, 20 nt, Human herpesvirus 1
ggccaucagcaggauuccgg

SEQ ID NO: 8679 - RNA, 22 nt, Human herpesvirus 1
uuuccggagccagcguugccgg

SEQ ID NO: 8680 - RNA, 20 nt, Human herpesvirus 1
gcgaacggaaacucccugag

SEQ ID NO: 8681 - RNA, 22 nt, Human herpesvirus 1
ugccguuguguugguaggaaag

SEQ ID NO: 8682 - RNA, 20 nt, Human herpesvirus 1
ggcguuuugcuccacgccgu

SEQ ID NO: 8683 - RNA, 22 nt, Human herpesvirus 1
gggcucgggggcgagcugugcc

SEQ ID NO: 8684 - RNA, 22 nt, Human herpesvirus 1
uacgacgagcucguccccccca

SEQ ID NO: 8685 - RNA, 22 nt, Human herpesvirus 1
ggccuaccuuagccucucggac

SEQ ID NO: 8686 - RNA, 20 nt, Human herpesvirus 1
cgcuguccuuagguuuuguc

SEQ ID NO: 8687 - RNA, 22 nt, Human herpesvirus 1
gcccucccgcccguggcaccag

SEQ ID NO: 8688 - RNA, 20 nt, Human herpesvirus 1
uuaagcaccuacggauuggc

SEQ ID NO: 8689 - RNA, 22 nt, Human herpesvirus 1
uccggagagcggcuuggugcgg

SEQ ID NO: 8690 - RNA, 22 nt, Human herpesvirus 1
gcggaagacccaggccgccucg

SEQ ID NO: 8691 - RNA, 22 nt, Human herpesvirus 1
gcccuguuugggaauaacgcca

SEQ ID NO: 8692 - RNA, 19 nt, Human herpesvirus 1
uuuauucccgaaguguggc

SEQ ID NO: 8693 - RNA, 22 nt, Human herpesvirus 1
gccgccgccccccggccccggc

SEQ ID NO: 8694 - RNA, 21 nt, Human herpesvirus 1
cgugggcccggggggcggggc

SEQ ID NO: 8695 - RNA, 22 nt, Human herpesvirus 1
uggccuggggguuuaccaggua

SEQ ID NO: 8696 - RNA, 22 nt, Human herpesvirus 1
uugcggguccccagguucagca

SEQ ID NO: 8697 - RNA, 22 nt, Human herpesvirus 1
ggaggcggagucgucgucaugg

SEQ ID NO: 8698 - RNA, 22 nt, Human herpesvirus 1
cccacuucggucuccgccucag

SEQ ID NO: 8699 - RNA, 22 nt, Human herpesvirus 1
accgccgggcgagcggcgucga

SEQ ID NO: 8700 - RNA, 22 nt, Human herpesvirus 1
gcuccgguccguccucuccgug

SEQ ID NO: 8701 - RNA, 22 nt, Human herpesvirus 1
ccggccuccgcguuggaugccu

SEQ ID NO: 8702 - RNA, 21 nt, Human herpesvirus 1
guggcggcgggggggaacgcg

SEQ ID NO: 8703 - RNA, 22 nt, Human herpesvirus 1
ggcggcgugccgcccgccgugu

SEQ ID NO: 8704 - RNA, 21 nt, Human herpesvirus 1
uggcgggcgcaaacgcgggcc

SEQ ID NO: 8705 - RNA, 22 nt, Human herpesvirus 1
ugauguugguguugacgacgga

SEQ ID NO: 8706 - RNA, 22 nt, Human herpesvirus 1
gucccgcaagaccacguaaggc

SEQ ID NO: 8707 - RNA, 22 nt, Human herpesvirus 1
gaggaaaauaaaauuacaucac

SEQ ID NO: 8708 - RNA, 22 nt, Human herpesvirus 1
ugcuguggccuguuuuugcugc

SEQ ID NO: 8709 - RNA, 22 nt, Human herpesvirus 1
gccgccgaacccggcggucccg

SEQ ID NO: 8710 - RNA, 22 nt, Human herpesvirus 1
gggccgaggccgggcugggggu

SEQ ID NO: 8711 - RNA, 22 nt, Human herpesvirus 1
uggggaccacgcccccaacacg

SEQ ID NO: 8712 - RNA, 22 nt, Human herpesvirus 1
uguguuuguugugggggcgugu

SEQ ID NO: 8713 - RNA, 22 nt, Human herpesvirus 1
cccgagcggcccgucaagcuuc

SEQ ID NO: 8714 - RNA, 15 nt, Human herpesvirus 1
cugacgugccugggg

SEQ ID NO: 8715 - RNA, 22 nt, Human herpesvirus 1
ugacgcccggcucgcgugggug

SEQ ID NO: 8716 - RNA, 22 nt, Human herpesvirus 1
caacgacgagaccgggcgggaa

SEQ ID NO: 8717 - RNA, 22 nt, Human herpesvirus 1
ggagaaacucccgcacggcccc

SEQ ID NO: 8718 - RNA, 21 nt, Human herpesvirus 1
gggugcgggugguuguuaucc

SEQ ID NO: 8719 - RNA, 22 nt, Human herpesvirus 1
uccgaacgcagccccgcuggaa

SEQ ID NO: 8720 - RNA, 19 nt, Human herpesvirus 1
ucagcgccgucagcgagga

SEQ ID NO: 8721 - RNA, 22 nt, Human herpesvirus 1
cgcgccccacccgagggccccc

SEQ ID NO: 8722 - RNA, 22 nt, Human herpesvirus 1
gucugggcucggggugggcggc

SEQ ID NO: 8723 - RNA, 22 nt, Human herpesvirus 1
ucgcguuuacgggggacagggc

SEQ ID NO: 8724 - RNA, 15 nt, Human herpesvirus 1
cgucccgccggagac

SEQ ID NO: 8725 - RNA, 22 nt, Human herpesvirus 1
cguggaaguacucgcgagcgcg

SEQ ID NO: 8726 - RNA, 18 nt, Human herpesvirus 1
gcguaaaggguaauggcg

SEQ ID NO: 8727 - RNA, 22 nt, Human herpesvirus 1
cguugcggagcaucccgcgccu

SEQ ID NO: 8728 - RNA, 18 nt, Human herpesvirus 1
cggggugguuccgucacg

SEQ ID NO: 8729 - RNA, 22 nt, Human herpesvirus 1
uagaguuugacaggcaagcaug

SEQ ID NO: 8730 - RNA, 22 nt, Human herpesvirus 1
gugcuugccugucuaacucgcu

SEQ ID NO: 8731 - RNA, 22 nt, Human herpesvirus 1
ugaggcggagaccgaagugggg

SEQ ID NO: 8732 - RNA, 22 nt, Human herpesvirus 1
caccaugacgacgacuccgccu

SEQ ID NO: 8733 - RNA, 22 nt, Human herpesvirus 1
ugaggcggagaccgaagugggg

SEQ ID NO: 8734 - RNA, 22 nt, Human herpesvirus 1
caccaugacgacgacuccgccu

SEQ ID NO: 8735 - RNA, 22 nt, Human herpesvirus 1
gcgucugguaugcgguugguau

SEQ ID NO: 8736 - RNA, 21 nt, Human herpesvirus 1
ccugggggcgugccgguccgc

SEQ ID NO: 8737 - RNA, 22 nt, Human herpesvirus 1
ugccagaugacguggcaucgcg

SEQ ID NO: 8738 - RNA, 22 nt, Human herpesvirus 1
cgcaaugccaccgggcuggccc

SEQ ID NO: 8739 - RNA, 22 nt, Human herpesvirus 1
gcguccagcgucuggccccgcu

SEQ ID NO: 8740 - RNA, 22 nt, Human herpesvirus 1
caacaggauggccguggggcug

SEQ ID NO: 8741 - RNA, 22 nt, Human herpesvirus 1
gcguacgaagggauguacgggu

SEQ ID NO: 8742 - RNA, 21 nt, Human herpesvirus 1
uggcgacguacgugucgucgu

SEQ ID NO: 8743 - RNA, 22 nt, Human herpesvirus 1
uggugccucagcguaacgccua

SEQ ID NO: 8744 - RNA, 22 nt, Human herpesvirus 1
guucugaauacguuucaggccc

SEQ ID NO: 8745 - RNA, 22 nt, Human herpesvirus 1
cgaucuucggacgggcggcucu

SEQ ID NO: 8746 - RNA, 22 nt, Human herpesvirus 1
cguccccguguucguccacgag

SEQ ID NO: 8747 - RNA, 22 nt, Human herpesvirus 1
gguugcaccaccaggaccaccg

SEQ ID NO: 8748 - RNA, 20 nt, Human herpesvirus 1
gccggguccuuuaugucgcc

SEQ ID NO: 8749 - RNA, 22 nt, Human herpesvirus 1
uggucguuaaugucgcggaugc

SEQ ID NO: 8750 - RNA, 19 nt, Human herpesvirus 1
uccaguggcuugcguucua

SEQ ID NO: 8751 - RNA, 22 nt, Human herpesvirus 1
ggguguguuuuggggggggccc

SEQ ID NO: 8752 - RNA, 16 nt, Human herpesvirus 1
uccccccgcuccuccc

SEQ ID NO: 8753 - RNA, 22 nt, Human herpesvirus 1
gccugcagucccucgggcaggg

SEQ ID NO: 8754 - RNA, 20 nt, Human herpesvirus 1
uccuccgcggggcgcucggc

SEQ ID NO: 8755 - RNA, 22 nt, Human herpesvirus 1
ugucgcagcgcagguggggcgc

SEQ ID NO: 8756 - RNA, 21 nt, Human herpesvirus 1
ugcacacggcgcacacgucgc

SEQ ID NO: 8757 - RNA, 22 nt, Human herpesvirus 1
gguuagggaguuguucggucau

SEQ ID NO: 8758 - RNA, 16 nt, Human herpesvirus 1
accaacuaccccgauc

SEQ ID NO: 8759 - RNA, 22 nt, Human herpesvirus 1
ggcuccuggccaggaucaccaa

SEQ ID NO: 8760 - RNA, 22 nt, Human herpesvirus 1
gcugcgaguccugcgccccgcc

SEQ ID NO: 8761 - RNA, 22 nt, Human herpesvirus 1
ucggcccgaguggaccacguua

SEQ ID NO: 8762 - RNA, 22 nt, Human herpesvirus 1
ucucguuuccggacgggucgcg

SEQ ID NO: 8763 - RNA, 22 nt, Human herpesvirus 1
cgcguuucucugugccaaaugc

SEQ ID NO: 8764 - RNA, 22 nt, Human herpesvirus 1
cgcuagcaucuucguggccgcg

SEQ ID NO: 8765 - RNA, 22 nt, Human herpesvirus 1
caaggaccuggagcccuucccc

SEQ ID NO: 8766 - RNA, 17 nt, Human herpesvirus 1
gcccgcggguccgcgug

SEQ ID NO: 8767 - RNA, 22 nt, Human herpesvirus 1
agcggccggccggcgcuuaggg

SEQ ID NO: 8768 - RNA, 22 nt, Human herpesvirus 1
ccuuggccgccccggcugcagg

SEQ ID NO: 8769 - RNA, 22 nt, Human herpesvirus 1
ggaggguuggagaccgggguug

SEQ ID NO: 8770 - RNA, 20 nt, Human herpesvirus 1
uccccuucaccgacaacccc

SEQ ID NO: 8771 - RNA, 22 nt, Human herpesvirus 1
gcacagacucuguucuugguuc

SEQ ID NO: 8772 - RNA, 22 nt, Human herpesvirus 1
gccagggacgagugcgacuggg

SEQ ID NO: 8773 - RNA, 22 nt, Human herpesvirus 1
agagcucggcaugaugcccgag

SEQ ID NO: 8774 - RNA, 20 nt, Human herpesvirus 1
ccugcaccgcaccgagcgcu

SEQ ID NO: 8775 - RNA, 22 nt, Human herpesvirus 1
uggcccucgguauaccccagcu

SEQ ID NO: 8776 - RNA, 22 nt, Human herpesvirus 1
gaacagcaucguaccggggcug

SEQ ID NO: 8777 - RNA, 22 nt, Human herpesvirus 1
ccacacacaccaacacgggccg

SEQ ID NO: 8778 - RNA, 22 nt, Human herpesvirus 1
ggccgcguacuggggggugugg

SEQ ID NO: 8779 - RNA, 22 nt, Human herpesvirus 1
cgaggugcgccaggucggcgac

SEQ ID NO: 8780 - RNA, 22 nt, Human herpesvirus 1
guuuaccgccaccagcaucgcg

SEQ ID NO: 8781 - RNA, 22 nt, Human herpesvirus 1
ugcaccucgcugcgaaccagcc

SEQ ID NO: 8782 - RNA, 22 nt, Human herpesvirus 1
ggcugcgcgugcgggcgcagga

SEQ ID NO: 8783 - RNA, 22 nt, Human herpesvirus 1
gggauggaaggacgggaagugg

SEQ ID NO: 8784 - RNA, 22 nt, Human herpesvirus 1
ccccccugccuuccacccuccg

SEQ ID NO: 8785 - RNA, 22 nt, Human herpesvirus 1
cgagugcgccguguugugucuc

SEQ ID NO: 8786 - RNA, 20 nt, Human herpesvirus 1
aaacacgcacggggccgccg

SEQ ID NO: 8787 - RNA, 22 nt, Human herpesvirus 1
ggacgucacccgccgccacccg

SEQ ID NO: 8788 - RNA, 22 nt, Human herpesvirus 1
ggcgugcggccuguggcguugc

SEQ ID NO: 8789 - RNA, 22 nt, Human herpesvirus 1
cgagggcgcggcggacggcagc

SEQ ID NO: 8790 - RNA, 17 nt, Human herpesvirus 1
cgucccccggguccccg

SEQ ID NO: 8791 - RNA, 22 nt, Human herpesvirus 1
gcagccccgaggaggccgugcu

SEQ ID NO: 8792 - RNA, 20 nt, Human herpesvirus 1
caggccgccaucaaggucgu

SEQ ID NO: 8793 - RNA, 22 nt, Human herpesvirus 1
uauccccgacucgugguuuggc

SEQ ID NO: 8794 - RNA, 20 nt, Human herpesvirus 1
cagccccacgaggcuagaau

SEQ ID NO: 8795 - RNA, 22 nt, Human herpesvirus 1
gcaaucagcgguucgccccgcg

SEQ ID NO: 8796 - RNA, 22 nt, Human herpesvirus 1
agcgaagaggaagcgguaaaag

SEQ ID NO: 8797 - RNA, 22 nt, Human herpesvirus 1
uuggagacguccuccucguccc

SEQ ID NO: 8798 - RNA, 22 nt, Human herpesvirus 1
gcacggcccgcacgcguacggg

SEQ ID NO: 8799 - RNA, 20 nt, Human herpesvirus 1
cauggcgugguuggccucgc

SEQ ID NO: 8800 - RNA, 22 nt, Human herpesvirus 1
ggacgaaucggaggccugggag

SEQ ID NO: 8801 - RNA, 22 nt, Human herpesvirus 1
gggccuuccggauccaaagguu

SEQ ID NO: 8802 - RNA, 22 nt, Human herpesvirus 1
gaacagguucuucagcaccacc

SEQ ID NO: 8803 - RNA, 22 nt, Human herpesvirus 1
ggaugcaagccagacagagccg

SEQ ID NO: 8804 - RNA, 22 nt, Human herpesvirus 1
ccacccggagcccaccacggac

SEQ ID NO: 8805 - RNA, 20 nt, Human herpesvirus 1
ccuggacgacggugaggcgg

SEQ ID NO: 8806 - RNA, 22 nt, Human herpesvirus 1
uuaagagccaggaggcugggau

SEQ ID NO: 8807 - RNA, 22 nt, Human herpesvirus 1
ccgccuuccagcugcugccggg

SEQ ID NO: 8808 - RNA, 22 nt, Human herpesvirus 1
ccagguggcgcacccggacgug

SEQ ID NO: 8809 - RNA, 21 nt, Human herpesvirus 1
cacccgcgcgggggucgcggg

SEQ ID NO: 8810 - RNA, 22 nt, Human herpesvirus 1
gcaggcucgcguucgggggccg

SEQ ID NO: 8811 - RNA, 21 nt, Human herpesvirus 1
gucuucgggauguaaagcagc

SEQ ID NO: 8812 - RNA, 22 nt, Human herpesvirus 1
acauaccgcccggcucgaucgc

SEQ ID NO: 8813 - RNA, 20 nt, Human herpesvirus 1
ggugaccggugcccaaucgu

SEQ ID NO: 8814 - RNA, 22 nt, Human herpesvirus 1
agcguucgcacuucgucccaau

SEQ ID NO: 8815 - RNA, 20 nt, Human herpesvirus 1
uagggcgaagugcgagcacu

SEQ ID NO: 8816 - RNA, 22 nt, Human herpesvirus 1
ggcgcuuuggcacccaguccca

SEQ ID NO: 8817 - RNA, 18 nt, Human herpesvirus 1
ggggucgugagcagguuc

SEQ ID NO: 8818 - RNA, 22 nt, Human herpesvirus 1
uauauagggucaggggguuccg

SEQ ID NO: 8819 - RNA, 22 nt, Human herpesvirus 1
gcgcccccggucccuguauaua

SEQ ID NO: 8820 - RNA, 22 nt, Human herpesvirus 1
cacccggagguuccggaggcgc

SEQ ID NO: 8821 - RNA, 20 nt, Human herpesvirus 1
ggggcccccgcuuccggaug

SEQ ID NO: 8822 - RNA, 22 nt, Human herpesvirus 1
ggcgagcugcucgccgccaagc

SEQ ID NO: 8823 - RNA, 22 nt, Human herpesvirus 1
cggcggucauuaaccgguuccu

SEQ ID NO: 8824 - RNA, 22 nt, Human herpesvirus 1
ugccgcggcucuccgggccccc

SEQ ID NO: 8825 - RNA, 22 nt, Human herpesvirus 1
gcggccaaggggcgucggcgac

SEQ ID NO: 8826 - RNA, 22 nt, Human herpesvirus 1
accgccgaugacgcugccgcga

SEQ ID NO: 8827 - RNA, 22 nt, Human herpesvirus 1
ggacgacguacacgauugccgu

SEQ ID NO: 8828 - RNA, 22 nt, Human herpesvirus 1
ucccggguacgaccaucacccg

SEQ ID NO: 8829 - RNA, 17 nt, Human herpesvirus 1
gugguucccccccgugg

SEQ ID NO: 8830 - RNA, 22 nt, Human herpesvirus 1
accgccuuaucuuggacgcguu

SEQ ID NO: 8831 - RNA, 20 nt, Human herpesvirus 1
gacgcggaguacuggagcgu

SEQ ID NO: 8832 - RNA, 22 nt, Human herpesvirus 1
cacaucgaggccccggccgcgc

SEQ ID NO: 8833 - RNA, 22 nt, Human herpesvirus 1
gugugcgcaggggaucgguggg

SEQ ID NO: 8834 - RNA, 22 nt, Human herpesvirus 1
accaggagaggcuuaagcucgg

SEQ ID NO: 8835 - RNA, 20 nt, Human herpesvirus 1
cgacgacaguaucgccuugu

SEQ ID NO: 8836 - RNA, 22 nt, Human herpesvirus 1
cccgcgcauggugccccgcagg

SEQ ID NO: 8837 - RNA, 20 nt, Human herpesvirus 1
cuguucgguaucgucguugg

SEQ ID NO: 8838 - RNA, 22 nt, Human herpesvirus 1
caccgucccccgacgaccucuu

SEQ ID NO: 8839 - RNA, 22 nt, Human herpesvirus 1
caaggacggcggggggccugca

SEQ ID NO: 8840 - RNA, 22 nt, Human herpesvirus 1
acccagccccccucgccucuac

SEQ ID NO: 8841 - RNA, 20 nt, Human herpesvirus 1
uaggcgcggcggaucugugu

SEQ ID NO: 8842 - RNA, 22 nt, Human herpesvirus 1
cgcaacggcgggagcuggguua

SEQ ID NO: 8843 - RNA, 21 nt, Human herpesvirus 1
gcauucgcucucgccuuuccg

SEQ ID NO: 8844 - RNA, 22 nt, Human herpesvirus 1
cccaaccgcacagucccaggua

SEQ ID NO: 8845 - RNA, 14 nt, Human herpesvirus 1
aacccgcggucagg

SEQ ID NO: 8846 - RNA, 22 nt, Human herpesvirus 1
uucacggccuucgaagccagcc

SEQ ID NO: 8847 - RNA, 15 nt, Human herpesvirus 1
cgggcgcgacggcgg

SEQ ID NO: 8848 - RNA, 22 nt, Human herpesvirus 1
cggcggcagaaccgggguccgu

SEQ ID NO: 8849 - RNA, 22 nt, Human herpesvirus 1
uaggucccaaauccugucgccc

SEQ ID NO: 8850 - RNA, 22 nt, Human herpesvirus 1
ucccgggccuucgcggccacgg

SEQ ID NO: 8851 - RNA, 20 nt, Human herpesvirus 1
cgucgcagcgauuuucguac

SEQ ID NO: 8852 - RNA, 22 nt, Human herpesvirus 1
gcccccgaagucucacaugugc

SEQ ID NO: 8853 - RNA, 20 nt, Human herpesvirus 1
cguauggagacuccggaagc

SEQ ID NO: 8854 - RNA, 22 nt, Human herpesvirus 1
acccaucaucgcgucgucggcc

SEQ ID NO: 8855 - RNA, 20 nt, Human herpesvirus 1
gcugacaaacgccuugcugu

SEQ ID NO: 8856 - RNA, 22 nt, Human herpesvirus 1
gccccagcccuccccggcccca

SEQ ID NO: 8857 - RNA, 20 nt, Human herpesvirus 1
cagcccuccccggccccagc

SEQ ID NO: 8858 - RNA, 22 nt, Human herpesvirus 1
gccccagccccagccccagccc

SEQ ID NO: 8859 - RNA, 20 nt, Human herpesvirus 1
gccccagccccagccccagc

SEQ ID NO: 8860 - RNA, 22 nt, Human herpesvirus 1
ggccucgauguggguggcggcg

SEQ ID NO: 8861 - RNA, 20 nt, Human herpesvirus 1
ccgccucugccaauuucuuc

SEQ ID NO: 8862 - RNA, 22 nt, Human herpesvirus 1
ggcgccaaggucgcccagcucc

SEQ ID NO: 8863 - RNA, 22 nt, Human herpesvirus 1
ggcggacgcucuuccuuggauc

SEQ ID NO: 8864 - RNA, 22 nt, Human herpesvirus 1
gccggccgcggcucggacagcg

SEQ ID NO: 8865 - RNA, 21 nt, Human herpesvirus 1
cccaucgggccacacggcagc

SEQ ID NO: 8866 - RNA, 22 nt, Human herpesvirus 1
ucucgaacaguuccguguccgu

SEQ ID NO: 8867 - RNA, 19 nt, Human herpesvirus 1
gaggcggagucgucgucau

SEQ ID NO: 8868 - RNA, 22 nt, Human herpesvirus 1
agugagggucgcgucgucuaug

SEQ ID NO: 8869 - RNA, 22 nt, Human herpesvirus 1
gagaacagcgucacccgauuac

SEQ ID NO: 8870 - RNA, 22 nt, Human herpesvirus 1
uguaccccguggugcacggcgu

SEQ ID NO: 8871 - RNA, 22 nt, Human herpesvirus 1
ccuacgugcccgcggaugcggu

SEQ ID NO: 8872 - RNA, 22 nt, Human herpesvirus 1
ucgcggguggcgccgucgccgc

SEQ ID NO: 8873 - RNA, 22 nt, Human herpesvirus 1
caguacgaggaggacgacuacc

SEQ ID NO: 8874 - RNA, 22 nt, Human herpesvirus 1
cgucgagugccuggccgccugc

SEQ ID NO: 8875 - RNA, 22 nt, Human herpesvirus 1
cgcuggccgagggcuucgacgg

SEQ ID NO: 8876 - RNA, 22 nt, Human herpesvirus 1
ucagggccgagaaggcggcgua

SEQ ID NO: 8877 - RNA, 22 nt, Human herpesvirus 1
augcuguucauggucccgaaga

SEQ ID NO: 8878 - RNA, 22 nt, Human herpesvirus 1
gggccgugauaugccgggucac

SEQ ID NO: 8879 - RNA, 22 nt, Human herpesvirus 1
gccagguuuucgucgcggaugu

SEQ ID NO: 8880 - RNA, 22 nt, Human herpesvirus 1
gagcgccgguuacgcccgaucg

SEQ ID NO: 8881 - RNA, 22 nt, Human herpesvirus 1
ucgcaggcgcccuggaggcgcu

SEQ ID NO: 8882 - RNA, 22 nt, Human herpesvirus 1
ugucuauaucucugggcgggcc

SEQ ID NO: 8883 - RNA, 19 nt, Human herpesvirus 1
cggugucugggaauagagc

SEQ ID NO: 8884 - RNA, 22 nt, Human herpesvirus 1
ugccgccagacacgcguuuucg

SEQ ID NO: 8885 - RNA, 20 nt, Human herpesvirus 1
ucggcgugcaggaggcggac

SEQ ID NO: 8886 - RNA, 22 nt, Human herpesvirus 1
cggcggcccgugauaaccacau

SEQ ID NO: 8887 - RNA, 22 nt, Human herpesvirus 1
ugugggcgucaaguggcuggcg

SEQ ID NO: 8888 - RNA, 22 nt, Human herpesvirus 1
uuccugcugcagagacgucacc

SEQ ID NO: 8889 - RNA, 22 nt, Human herpesvirus 1
ugauggucucguuggucccggg

SEQ ID NO: 8890 - RNA, 22 nt, Human herpesvirus 1
ugugugcuugagucuguccgaa

SEQ ID NO: 8891 - RNA, 22 nt, Human herpesvirus 1
cuugccccccuccccgcacaga

SEQ ID NO: 8892 - RNA, 22 nt, Human herpesvirus 1
uagaguuugacaggcaagcaug

SEQ ID NO: 8893 - RNA, 22 nt, Human herpesvirus 1
gugcuugccugucuaacucgcu

SEQ ID NO: 8894 - RNA, 22 nt, Human herpesvirus 1
ucgaugugggggugaccuccgg

SEQ ID NO: 8895 - RNA, 19 nt, Human herpesvirus 1
cgggggaccccgauguggg

SEQ ID NO: 8896 - RNA, 22 nt, Human herpesvirus 1
ugggccuaccguggacuccauu

SEQ ID NO: 8897 - RNA, 20 nt, Human herpesvirus 1
uggggggagcggugguugag

SEQ ID NO: 8898 - RNA, 22 nt, Human herpesvirus 1
gcccggugcggcccggggggga

SEQ ID NO: 8899 - RNA, 22 nt, Human herpesvirus 1
cccccagucguacaggggauuu

SEQ ID NO: 8900 - RNA, 22 nt, Human herpesvirus 1
gggcggguacuggcccuugggc

SEQ ID NO: 8901 - RNA, 18 nt, Human herpesvirus 1
ggcaggaagacgggaacc

SEQ ID NO: 8902 - RNA, 22 nt, Human herpesvirus 1
ucggggggggggggggggggcg

SEQ ID NO: 8903 - RNA, 22 nt, Human herpesvirus 1
ccgcccauccgcggccccuccc

SEQ ID NO: 8904 - RNA, 22 nt, Human herpesvirus 1
ucccaccgccaucagccuuacc

SEQ ID NO: 8905 - RNA, 22 nt, Human herpesvirus 1
uauuggacuggaggaggaggaa

SEQ ID NO: 8906 - RNA, 22 nt, Human herpesvirus 1
gggaaguugcggucgcugugac

SEQ ID NO: 8907 - RNA, 19 nt, Human herpesvirus 1
ugcugcggcuaggcggacc

SEQ ID NO: 8908 - RNA, 22 nt, Human herpesvirus 1
ccgccgguccgcggacgaccac

SEQ ID NO: 8909 - RNA, 17 nt, Human herpesvirus 1
ucccgagacuuauaggg

SEQ ID NO: 8910 - RNA, 22 nt, Human herpesvirus 1
cgggugggugugcgggacgcgc

SEQ ID NO: 8911 - RNA, 21 nt, Human herpesvirus 1
cgcgcgggucugaccuggacg

SEQ ID NO: 8912 - RNA, 22 nt, Human herpesvirus 1
ggggggaggagcggggggagga

SEQ ID NO: 8913 - RNA, 22 nt, Human herpesvirus 1
ggggaggagcggggggaggagc

SEQ ID NO: 8914 - RNA, 22 nt, Human herpesvirus 1
gacaccgcagcgcgccggcugc

SEQ ID NO: 8915 - RNA, 22 nt, Human herpesvirus 1
cucaacgccgugcugggcgcug

SEQ ID NO: 8916 - RNA, 22 nt, Human herpesvirus 1
ucuucgggggugccgacgcagg

SEQ ID NO: 8917 - RNA, 20 nt, Human herpesvirus 1
gacgcaggcgcccccggcga

SEQ ID NO: 8918 - RNA, 22 nt, Human herpesvirus 1
gcuggcggcggcggccagcgca

SEQ ID NO: 8919 - RNA, 20 nt, Human herpesvirus 1
gcgcuggcggccgccgccgc

SEQ ID NO: 8920 - RNA, 22 nt, Human herpesvirus 1
gcuggcggcggcggccagcgca

SEQ ID NO: 8921 - RNA, 20 nt, Human herpesvirus 1
gcgcuggcggccgccgccgc

SEQ ID NO: 8922 - RNA, 22 nt, Human herpesvirus 1
agccccgguacgaugcuguucc

SEQ ID NO: 8923 - RNA, 22 nt, Human herpesvirus 1
gcagcugggguauaccgagggc

SEQ ID NO: 8924 - RNA, 22 nt, Human herpesvirus 1
aguugugaucauugccgcguug

SEQ ID NO: 8925 - RNA, 14 nt, Human herpesvirus 1
ccucgugggcacuu

SEQ ID NO: 8926 - RNA, 22 nt, Human herpesvirus 1
gccaacacgaguacaugcaucu

SEQ ID NO: 8927 - RNA, 22 nt, Human herpesvirus 1
auuccaugcuauucgugcagcg

SEQ ID NO: 8928 - RNA, 22 nt, Human herpesvirus 1
gauagcucuccucccgcgcccg

SEQ ID NO: 8929 - RNA, 22 nt, Human herpesvirus 1
cguggaagaaacgagagagcgc

SEQ ID NO: 8930 - RNA, 22 nt, Human herpesvirus 1
ccuccaagagcucuucggggag

SEQ ID NO: 8931 - RNA, 21 nt, Human herpesvirus 1
cccccuuuagcacguacgugg

SEQ ID NO: 8932 - RNA, 22 nt, Human herpesvirus 1
uugccgucgucguccucguccu

SEQ ID NO: 8933 - RNA, 20 nt, Human herpesvirus 1
aggacgaagaggaugcggac

SEQ ID NO: 8934 - RNA, 22 nt, Human herpesvirus 1
uugccgucgucguccucguccu

SEQ ID NO: 8935 - RNA, 20 nt, Human herpesvirus 1
aggacgaagaggaugcggac

SEQ ID NO: 8936 - RNA, 22 nt, Human herpesvirus 1
cguuucgguucaugggccccga

SEQ ID NO: 8937 - RNA, 17 nt, Human herpesvirus 1
gauccugugccgcgccg

SEQ ID NO: 8938 - RNA, 22 nt, Human herpesvirus 1
uaauacgcccugcgguacgcgg

SEQ ID NO: 8939 - RNA, 22 nt, Human herpesvirus 1
cgcaccucgugguggacguaua

SEQ ID NO: 8940 - RNA, 22 nt, Human herpesvirus 1
agcuccccaugaucccggcggg

SEQ ID NO: 8941 - RNA, 21 nt, Human herpesvirus 1
gcagucggagcgggggggcgg

SEQ ID NO: 8942 - RNA, 22 nt, Human herpesvirus 1
agagaccccaggguaccgcgug

SEQ ID NO: 8943 - RNA, 20 nt, Human herpesvirus 1
cgacaaccccggucucccag

SEQ ID NO: 8944 - RNA, 22 nt, Human herpesvirus 1
acgggccgcagcggcaccgugc

SEQ ID NO: 8945 - RNA, 22 nt, Human herpesvirus 1
gggggccguggaggugcugggg

SEQ ID NO: 8946 - RNA, 22 nt, Human herpesvirus 1
acgggccgcagcggcaccgugc

SEQ ID NO: 8947 - RNA, 22 nt, Human herpesvirus 1
gggggccguggaggugcugggg

SEQ ID NO: 8948 - RNA, 22 nt, Human herpesvirus 1
acgcuccaguacuccgcgucca

SEQ ID NO: 8949 - RNA, 19 nt, Human herpesvirus 1
gcguccaagauaaggcggu

SEQ ID NO: 8950 - RNA, 22 nt, Human herpesvirus 1
auugcccgaggcgcauaaaggg

SEQ ID NO: 8951 - RNA, 22 nt, Human herpesvirus 1
cgccuagccgcagcaaauuaaa

SEQ ID NO: 8952 - RNA, 22 nt, Human herpesvirus 1
accggcuccggcguccuucgcg

SEQ ID NO: 8953 - RNA, 18 nt, Human herpesvirus 1
agggcgcucagggcggcg

SEQ ID NO: 8954 - RNA, 22 nt, Human herpesvirus 1
aagcgucgccgccaaccgggcc

SEQ ID NO: 8955 - RNA, 22 nt, Human herpesvirus 1
uccuuccugugcaggcgacgcc

SEQ ID NO: 8956 - RNA, 22 nt, Human herpesvirus 1
aagcugagucccgcccaggcgc

SEQ ID NO: 8957 - RNA, 21 nt, Human herpesvirus 1
cguccucgggcgcaugugucu

SEQ ID NO: 8958 - RNA, 22 nt, Human herpesvirus 1
uaaccggggcgaccgugucggg

SEQ ID NO: 8959 - RNA, 20 nt, Human herpesvirus 1
acccuggguggucgcggaag

SEQ ID NO: 8960 - RNA, 22 nt, Human herpesvirus 1
aaagaagcucacauagucccca

SEQ ID NO: 8961 - RNA, 21 nt, Human herpesvirus 1
gaucucccggggggaagcgag

SEQ ID NO: 8962 - RNA, 22 nt, Human herpesvirus 1
uaaauuuuuagagcagcccccg

SEQ ID NO: 8963 - RNA, 22 nt, Human herpesvirus 1
gugcguggccuuacaaaucugc

SEQ ID NO: 8964 - RNA, 22 nt, Human herpesvirus 1
acagcuuuguaaagacucaggg

SEQ ID NO: 8965 - RNA, 18 nt, Human herpesvirus 1
guuugccuacagguuccu

SEQ ID NO: 8966 - RNA, 22 nt, Human herpesvirus 1
uacgcacggguguuugccuuug

SEQ ID NO: 8967 - RNA, 21 nt, Human herpesvirus 1
gaggcggcacgcgacggccaa

SEQ ID NO: 8968 - RNA, 22 nt, Human herpesvirus 1
acagaaacccaccgguccgccu

SEQ ID NO: 8969 - RNA, 20 nt, Human herpesvirus 1
ugggcggaggagggggggac

SEQ ID NO: 8970 - RNA, 22 nt, Human herpesvirus 1
acauaagcuugccguuaagacc

SEQ ID NO: 8971 - RNA, 20 nt, Human herpesvirus 1
ugguuugccguugagcucau

SEQ ID NO: 8972 - RNA, 22 nt, Human herpesvirus 1
accgccucgcgccccagcgcca

SEQ ID NO: 8973 - RNA, 22 nt, Human herpesvirus 1
cagcggcgcgcccaggccccag

SEQ ID NO: 8974 - RNA, 22 nt, Human herpesvirus 1
accgccaggugcugcgccuguc

SEQ ID NO: 8975 - RNA, 20 nt, Human herpesvirus 1
gaucgggaccgugugccacc

SEQ ID NO: 8976 - RNA, 22 nt, Human herpesvirus 1
accgcgcgccccaggucgccca

SEQ ID NO: 8977 - RNA, 18 nt, Human herpesvirus 1
gcccaggcccgcaaacau

SEQ ID NO: 8978 - RNA, 22 nt, Human herpesvirus 1
acccgccgccguggcacugcga

SEQ ID NO: 8979 - RNA, 19 nt, Human herpesvirus 1
ccguggcccgcgcggccgc

SEQ ID NO: 8980 - RNA, 22 nt, Human herpesvirus 1
acguguauggccaccauccugc

SEQ ID NO: 8981 - RNA, 21 nt, Human herpesvirus 1
uccgugggggcggcugacaag

SEQ ID NO: 8982 - RNA, 22 nt, Human herpesvirus 1
acgcgguagcgcacguugccgc

SEQ ID NO: 8983 - RNA, 20 nt, Human herpesvirus 1
gcggcgcgucgggguacagg

SEQ ID NO: 8984 - RNA, 22 nt, Human herpesvirus 1
aguugcgugguggugguuuucc

SEQ ID NO: 8985 - RNA, 22 nt, Human herpesvirus 1
accgucuauauaaacccgcagu

SEQ ID NO: 8986 - RNA, 22 nt, Human herpesvirus 1
agccgcggcgcgccaggcgggc

SEQ ID NO: 8987 - RNA, 21 nt, Human herpesvirus 1
caccagguggcgcacccggac

SEQ ID NO: 8988 - RNA, 22 nt, Human herpesvirus 1
agcucgcgcagccacgcgcgca

SEQ ID NO: 8989 - RNA, 21 nt, Human herpesvirus 1
cgugcggcggcggcggggaag

SEQ ID NO: 8990 - RNA, 22 nt, Human herpesvirus 1
agacgaucguccacggcgucca

SEQ ID NO: 8991 - RNA, 21 nt, Human herpesvirus 1
ggaucgagguaccgucggugu

SEQ ID NO: 8992 - RNA, 22 nt, Human herpesvirus 1
gagcggggggaggagcgggggg

SEQ ID NO: 8993 - RNA, 22 nt, Human herpesvirus 1
aaacgggccccccccaaaacac

SEQ ID NO: 8994 - RNA, 22 nt, Human herpesvirus 1
aucagccuuaccacgcccgacc

SEQ ID NO: 8995 - RNA, 18 nt, Human herpesvirus 1
ccaaguauuggacuggag

SEQ ID NO: 8996 - RNA, 22 nt, Human herpesvirus 1
auggagccggucgugccgcugg

SEQ ID NO: 8997 - RNA, 16 nt, Human herpesvirus 1
cgcgcgaacguuuccg

SEQ ID NO: 8998 - RNA, 22 nt, Human herpesvirus 1
auacuccccgggugcuacaugc

SEQ ID NO: 8999 - RNA, 19 nt, Human herpesvirus 1
uuggggcugggguuggggc

SEQ ID NO: 9000 - RNA, 22 nt, Human herpesvirus 1
auagccaggccuggcucagacg

SEQ ID NO: 9001 - RNA, 21 nt, Human herpesvirus 1
uuucggguggguucugaggcc

SEQ ID NO: 9002 - RNA, 22 nt, Human herpesvirus 1
aucccacgggccgccggccgau

SEQ ID NO: 9003 - RNA, 17 nt, Human herpesvirus 1
ucgcgcggcccgaaaac

SEQ ID NO: 9004 - RNA, 22 nt, Human herpesvirus 1
auggcgcggcucaacuggccgc

SEQ ID NO: 9005 - RNA, 19 nt, Human herpesvirus 1
ccagcgccuggguggcggc

SEQ ID NO: 9006 - RNA, 22 nt, Human herpesvirus 1
uauucugucaccgggccgcugc

SEQ ID NO: 9007 - RNA, 22 nt, Human herpesvirus 1
cugauuaucggcgaggugacgc

SEQ ID NO: 9008 - RNA, 22 nt, Human herpesvirus 1
uuccgccaacaggccccccagg

SEQ ID NO: 9009 - RNA, 22 nt, Human herpesvirus 1
ucccaggccacccuuggcacca

SEQ ID NO: 9010 - RNA, 22 nt, Human herpesvirus 1
uauuuuuccuaagauggggcgg

SEQ ID NO: 9011 - RNA, 15 nt, Human herpesvirus 1
gcccccaccccgucg

SEQ ID NO: 9012 - RNA, 22 nt, Human herpesvirus 1
ucggguggcucccgccggaucc

SEQ ID NO: 9013 - RNA, 21 nt, Human herpesvirus 1
accucgcgggggccgcuuaag

SEQ ID NO: 9014 - RNA, 22 nt, Human herpesvirus 1
ucgaauccgaugcugucucgga

SEQ ID NO: 9015 - RNA, 20 nt, Human herpesvirus 1
caaggcuguaucggauucua

SEQ ID NO: 9016 - RNA, 22 nt, Human herpesvirus 1
cgggccaggcucgcggggggag

SEQ ID NO: 9017 - RNA, 22 nt, Human herpesvirus 1
ccaccgcgggccaggcccccag

SEQ ID NO: 9018 - RNA, 22 nt, Human herpesvirus 1
cgccgaagaugcgccgcucggg

SEQ ID NO: 9019 - RNA, 20 nt, Human herpesvirus 1
gccgcggaucagguuggcag

SEQ ID NO: 9020 - RNA, 22 nt, Human herpesvirus 1
cgggcgccauggcgggacuggg

SEQ ID NO: 9021 - RNA, 22 nt, Human herpesvirus 1
cggccacccaggugacgccuuc

SEQ ID NO: 9022 - RNA, 22 nt, Human herpesvirus 1
ccgaaggugacgaacccggggu

SEQ ID NO: 9023 - RNA, 22 nt, Human herpesvirus 1
ccgggugguggcgucgacccca

SEQ ID NO: 9024 - RNA, 22 nt, Human herpesvirus 1
cgucuacacccacgcagucgcc

SEQ ID NO: 9025 - RNA, 21 nt, Human herpesvirus 1
gggagugugguucuggaacuc

SEQ ID NO: 9026 - RNA, 22 nt, Human herpesvirus 1
cucccuuagcguggggccgggc

SEQ ID NO: 9027 - RNA, 20 nt, Human herpesvirus 1
ggccccgggcaccagggaac

SEQ ID NO: 9028 - RNA, 22 nt, Human herpesvirus 1
ucgcgccccagcgccacguaca

SEQ ID NO: 9029 - RNA, 20 nt, Human herpesvirus 1
cccaggccccagcgcgcgca

SEQ ID NO: 9030 - RNA, 22 nt, Human herpesvirus 1
cccacguacuccaagaaggcau

SEQ ID NO: 9031 - RNA, 21 nt, Human herpesvirus 1
ccuguguuuuugugccuggcu

SEQ ID NO: 9032 - RNA, 22 nt, Human herpesvirus 1
cugcgccuggccgaccagaagg

SEQ ID NO: 9033 - RNA, 22 nt, Human herpesvirus 1
ucugccggacacccaggggcga

SEQ ID NO: 9034 - RNA, 22 nt, Human herpesvirus 1
cgccgccgucgcgcccgccccg

SEQ ID NO: 9035 - RNA, 16 nt, Human herpesvirus 1
cuggcuucgaaggccg

SEQ ID NO: 9036 - RNA, 22 nt, Human herpesvirus 1
cgucggcgggccucaccauggg

SEQ ID NO: 9037 - RNA, 17 nt, Human herpesvirus 1
gugcccuuuuuagauuu

SEQ ID NO: 9038 - RNA, 22 nt, Human herpesvirus 1
cagcaaaaacaggccacagcac

SEQ ID NO: 9039 - RNA, 21 nt, Human herpesvirus 1
ugauguaauuuuauuuuccuc

SEQ ID NO: 9040 - RNA, 22 nt, Human herpesvirus 1
cggcuaacacacacgccggcaa

SEQ ID NO: 9041 - RNA, 12 nt, Human herpesvirus 1
uugcgcgguccc

SEQ ID NO: 9042 - RNA, 22 nt, Human herpesvirus 1
ccgugggccgugccgacucggu

SEQ ID NO: 9043 - RNA, 22 nt, Human herpesvirus 1
gaguggaccguggcguggaccc

SEQ ID NO: 9044 - RNA, 22 nt, Human herpesvirus 1
ccgugggccaggcgcugccccc

SEQ ID NO: 9045 - RNA, 17 nt, Human herpesvirus 1
cugcugcaugucugcgg

SEQ ID NO: 9046 - RNA, 22 nt, Human herpesvirus 1
caaauaaucagacgacaaccgc

SEQ ID NO: 9047 - RNA, 14 nt, Human herpesvirus 1
gcucguguuuauug

SEQ ID NO: 9048 - RNA, 22 nt, Human herpesvirus 1
cagccugaugggcggcaaaaac

SEQ ID NO: 9049 - RNA, 18 nt, Human herpesvirus 1
uuugaccgcacccgcaag

SEQ ID NO: 9050 - RNA, 22 nt, Human herpesvirus 1
caaagccccgcggccgaccgcg

SEQ ID NO: 9051 - RNA, 20 nt, Human herpesvirus 1
ccgucgcgaccuaggggccu

SEQ ID NO: 9052 - RNA, 22 nt, Human herpesvirus 1
caccgacgguaccucgauccgg

SEQ ID NO: 9053 - RNA, 22 nt, Human herpesvirus 1
cuggacgccguggacgaucguc

SEQ ID NO: 9054 - RNA, 22 nt, Human herpesvirus 1
caugaggaaacacccgggacgg

SEQ ID NO: 9055 - RNA, 20 nt, Human herpesvirus 1
cggccuccuccuuccuccug

SEQ ID NO: 9056 - RNA, 22 nt, Human herpesvirus 1
ccacgggcuuccggagacggcg

SEQ ID NO: 9057 - RNA, 22 nt, Human herpesvirus 1
cuccccggguugcucguacacc

SEQ ID NO: 9058 - RNA, 22 nt, Human herpesvirus 1
ccgcagcaccgguuggaauuga

SEQ ID NO: 9059 - RNA, 20 nt, Human herpesvirus 1
cgccccucgaccgacugccc

SEQ ID NO: 9060 - RNA, 22 nt, Human herpesvirus 1
ccgggaccaacgggacggcggg

SEQ ID NO: 9061 - RNA, 20 nt, Human herpesvirus 1
cgccuugccgcccccccauu

SEQ ID NO: 9062 - RNA, 22 nt, Human herpesvirus 1
ccaaaaacaccacaggggaccg

SEQ ID NO: 9063 - RNA, 16 nt, Human herpesvirus 1
gugauuguguguuuau

SEQ ID NO: 9064 - RNA, 22 nt, Human herpesvirus 1
ccacggucgugcagccaucccu

SEQ ID NO: 9065 - RNA, 20 nt, Human herpesvirus 1
ggacgccgggcccgcggccu

SEQ ID NO: 9066 - RNA, 22 nt, Human herpesvirus 1
ucccgaacgcgcgaucgaaaug

SEQ ID NO: 9067 - RNA, 18 nt, Human herpesvirus 1
aacagcgccaguuccacg

SEQ ID NO: 9068 - RNA, 22 nt, Human herpesvirus 1
cccgucagcgccgcguucucgc

SEQ ID NO: 9069 - RNA, 20 nt, Human herpesvirus 1
cguaggcgcggcgcaggcug

SEQ ID NO: 9070 - RNA, 22 nt, Human herpesvirus 1
ucccgcgcgcuagguccuuggg

SEQ ID NO: 9071 - RNA, 17 nt, Human herpesvirus 1
ccauccaagccagccaa

SEQ ID NO: 9072 - RNA, 22 nt, Human herpesvirus 1
cccugcucgcccgcuucaaucc

SEQ ID NO: 9073 - RNA, 21 nt, Human herpesvirus 1
uuugacgcgggaggccgccuu

SEQ ID NO: 9074 - RNA, 22 nt, Human herpesvirus 1
ccuuuaacuacauuaaauuggg

SEQ ID NO: 9075 - RNA, 14 nt, Human herpesvirus 1
ucccgguugauuuu

SEQ ID NO: 9076 - RNA, 22 nt, Human herpesvirus 1
ccuuccccgcccggucgaguuc

SEQ ID NO: 9077 - RNA, 20 nt, Human herpesvirus 1
uggccugggcccgggacuuu

SEQ ID NO: 9078 - RNA, 22 nt, Human herpesvirus 1
cgccgugcugggcuuuaugcgc

SEQ ID NO: 9079 - RNA, 22 nt, Human herpesvirus 1
cgcggcccaccgcgcggauaua

SEQ ID NO: 9080 - RNA, 22 nt, Human herpesvirus 1
cgaccgggggccgauacagccg

SEQ ID NO: 9081 - RNA, 21 nt, Human herpesvirus 1
acgauggccaccagcggacag

SEQ ID NO: 9082 - RNA, 22 nt, Human herpesvirus 1
ucgagggggacggggugcugua

SEQ ID NO: 9083 - RNA, 22 nt, Human herpesvirus 1
ggggcgcuugugagacccgaag

SEQ ID NO: 9084 - RNA, 22 nt, Human herpesvirus 1
ucgagggggacggggugcugua

SEQ ID NO: 9085 - RNA, 22 nt, Human herpesvirus 1
ggggcgcuugugagacccgaag

SEQ ID NO: 9086 - RNA, 22 nt, Human herpesvirus 1
ucgaauucgccaaugacaagac

SEQ ID NO: 9087 - RNA, 22 nt, Human herpesvirus 1
uugugucaucauagaacuaaag

SEQ ID NO: 9088 - RNA, 22 nt, Human herpesvirus 1
cgacgaccauccccagggugcc

SEQ ID NO: 9089 - RNA, 20 nt, Human herpesvirus 1
cccggggcgaggagaaagag

SEQ ID NO: 9090 - RNA, 22 nt, Human herpesvirus 1
cgcuauacguccaccacgaggu

SEQ ID NO: 9091 - RNA, 20 nt, Human herpesvirus 1
cguaccgcagggcguauuau

SEQ ID NO: 9092 - RNA, 22 nt, Human herpesvirus 1
ggccgaagcgcgugcgcacgcg

SEQ ID NO: 9093 - RNA, 21 nt, Human herpesvirus 1
cgcggcacaggcgcagcggcg

SEQ ID NO: 9094 - RNA, 22 nt, Human herpesvirus 1
cggcgaggagcgccgccggccc

SEQ ID NO: 9095 - RNA, 22 nt, Human herpesvirus 1
ggcggccgguucgccccccgaa

SEQ ID NO: 9096 - RNA, 22 nt, Human herpesvirus 1
cucggaggugcgucucggccag

SEQ ID NO: 9097 - RNA, 22 nt, Human herpesvirus 1
gccgcgugggcggcaucucggu

SEQ ID NO: 9098 - RNA, 22 nt, Human herpesvirus 1
gguuggccguggccgcgaaggc

SEQ ID NO: 9099 - RNA, 22 nt, Human herpesvirus 1
cgcucuggccguggucguacau

SEQ ID NO: 9100 - RNA, 22 nt, Human herpesvirus 1
uccggggcaaggaggggcgcgg

SEQ ID NO: 9101 - RNA, 22 nt, Human herpesvirus 1
cgagcuccuccaggccgugaau

SEQ ID NO: 9102 - RNA, 22 nt, Human herpesvirus 1
gcacagccgcggucgucccgau

SEQ ID NO: 9103 - RNA, 21 nt, Human herpesvirus 1
ggcgcagcggcagguuguggu

SEQ ID NO: 9104 - RNA, 22 nt, Human herpesvirus 1
ggggguccgcguucgucggaaa

SEQ ID NO: 9105 - RNA, 15 nt, Human herpesvirus 1
cgacguccaccucgc

SEQ ID NO: 9106 - RNA, 22 nt, Human herpesvirus 1
guuguugaggcgguccgcguac

SEQ ID NO: 9107 - RNA, 20 nt, Human herpesvirus 1
gcgaggagccgcuggauaac

SEQ ID NO: 9108 - RNA, 22 nt, Human herpesvirus 1
uguacgagcaacccggggaggu

SEQ ID NO: 9109 - RNA, 20 nt, Human herpesvirus 1
cgucuccggaagcccguggg

SEQ ID NO: 9110 - RNA, 22 nt, Human herpesvirus 1
gagcgcuuuccggacgcccggc

SEQ ID NO: 9111 - RNA, 20 nt, Human herpesvirus 1
gcgagugggagaugcuacgc

SEQ ID NO: 9112 - RNA, 22 nt, Human herpesvirus 1
ugauguugguguugacgacgga

SEQ ID NO: 9113 - RNA, 22 nt, Human herpesvirus 1
uggucccgcaagaccacguaag

SEQ ID NO: 9114 - RNA, 22 nt, Human herpesvirus 1
gcggcgguggccggccgcgacg

SEQ ID NO: 9115 - RNA, 15 nt, Human herpesvirus 1
gccgggcagccccgg

SEQ ID NO: 9116 - RNA, 22 nt, Human herpesvirus 1
gaucgaggacuggcuggcgcuc

SEQ ID NO: 9117 - RNA, 21 nt, Human herpesvirus 1
guaccuaagcgaggagaugau

SEQ ID NO: 9118 - RNA, 22 nt, Human herpesvirus 1
gccgggauuuggggggggugcu

SEQ ID NO: 9119 - RNA, 21 nt, Human herpesvirus 1
ugagcucggcuccgaggcggg

SEQ ID NO: 9120 - RNA, 22 nt, Human herpesvirus 1
ggacugcaggagcuucagggag

SEQ ID NO: 9121 - RNA, 18 nt, Human herpesvirus 1
auccccguggcccguugc

SEQ ID NO: 9122 - RNA, 22 nt, Human herpesvirus 1
ggccacgaacgacgggagcggc

SEQ ID NO: 9123 - RNA, 22 nt, Human herpesvirus 1
gcggaccgggagcgggagucgc

SEQ ID NO: 9124 - RNA, 22 nt, Human herpesvirus 1
guuggggcuggggcuggggcug

SEQ ID NO: 9125 - RNA, 21 nt, Human herpesvirus 1
ggcuggggcuggggcuggggc

SEQ ID NO: 9126 - RNA, 22 nt, Human herpesvirus 1
gcuggggccggggagggcuggg

SEQ ID NO: 9127 - RNA, 20 nt, Human herpesvirus 1
gggccggggagggcuggggc

SEQ ID NO: 9128 - RNA, 22 nt, Human herpesvirus 1
gcuggggccggggagggcuggg

SEQ ID NO: 9129 - RNA, 20 nt, Human herpesvirus 1
gggccggggagggcuggggc

SEQ ID NO: 9130 - RNA, 22 nt, Human herpesvirus 1
gcgugaggccgcccgcggggac

SEQ ID NO: 9131 - RNA, 22 nt, Human herpesvirus 1
uccgcguggcgcgucuuccggg

SEQ ID NO: 9132 - RNA, 22 nt, Human herpesvirus 1
gaggcgggcgcggcggacagcc

SEQ ID NO: 9133 - RNA, 22 nt, Human herpesvirus 1
cgaggauccccgcggcgccgua

SEQ ID NO: 9134 - RNA, 22 nt, Human herpesvirus 1
gaggcgggcgcggcggacagcc

SEQ ID NO: 9135 - RNA, 22 nt, Human herpesvirus 1
cgaggauccccgcggcgccgua

SEQ ID NO: 9136 - RNA, 22 nt, Human herpesvirus 1
gagcgggggaugccgcggcccc

SEQ ID NO: 9137 - RNA, 21 nt, Human herpesvirus 1
ggcgcccgcgcaccacgucuc

SEQ ID NO: 9138 - RNA, 22 nt, Human herpesvirus 1
ccaccgguccgccuuuuuugca

SEQ ID NO: 9139 - RNA, 22 nt, Human herpesvirus 1
cggaggagggggggacgcgggg

SEQ ID NO: 9140 - RNA, 22 nt, Human herpesvirus 1
gaggggguagggggcccggggc

SEQ ID NO: 9141 - RNA, 22 nt, Human herpesvirus 1
cacagccgcccagucgccgcca

SEQ ID NO: 9142 - RNA, 22 nt, Human herpesvirus 1
gaacccgagggugggggcgcca

SEQ ID NO: 9143 - RNA, 15 nt, Human herpesvirus 1
cgacacgcgggaaag

SEQ ID NO: 9144 - RNA, 22 nt, Human herpesvirus 1
gaacgcggccacgaagaugcua

SEQ ID NO: 9145 - RNA, 20 nt, Human herpesvirus 1
cccccaggcauuuggcacag

SEQ ID NO: 9146 - RNA, 22 nt, Human herpesvirus 1
gaccuguuuuucaagcgccuga

SEQ ID NO: 9147 - RNA, 17 nt, Human herpesvirus 1
cgagaagaacgucacau

SEQ ID NO: 9148 - RNA, 22 nt, Human herpesvirus 1
ugccgcuuuaucccacggccuc

SEQ ID NO: 9149 - RNA, 22 nt, Human herpesvirus 1
aagccuacuacucggaaagcga

SEQ ID NO: 9150 - RNA, 22 nt, Human herpesvirus 1
gcccaucaacaggaggucagug

SEQ ID NO: 9151 - RNA, 19 nt, Human herpesvirus 1
cguacgcgaccguguuggu

SEQ ID NO: 9152 - RNA, 22 nt, Human herpesvirus 1
uggcggccgucccggggcuggc

SEQ ID NO: 9153 - RNA, 20 nt, Human herpesvirus 1
ccagccccccgcggccggag

SEQ ID NO: 9154 - RNA, 22 nt, Human herpesvirus 1
gggagagcggcggcccgcggcg

SEQ ID NO: 9155 - RNA, 19 nt, Human herpesvirus 1
cgcuggcggccgucucgag

SEQ ID NO: 9156 - RNA, 22 nt, Human herpesvirus 1
ggacugaccuggccucuggccg

SEQ ID NO: 9157 - RNA, 22 nt, Human herpesvirus 1
ggggggguuaacuacacuauag

SEQ ID NO: 9158 - RNA, 22 nt, Human herpesvirus 1
ggccccccgccguccuugcauc

SEQ ID NO: 9159 - RNA, 22 nt, Human herpesvirus 1
ugcaagaggucgucgggggacg

SEQ ID NO: 9160 - RNA, 22 nt, Human herpesvirus 1
gggacggacccauggaguaacg

SEQ ID NO: 9161 - RNA, 21 nt, Human herpesvirus 1
ggaacuccaugcggguggaau

SEQ ID NO: 9162 - RNA, 22 nt, Human herpesvirus 1
guccucgucgacaucguccgcg

SEQ ID NO: 9163 - RNA, 20 nt, Human herpesvirus 1
ggucguccucuaugggguag

SEQ ID NO: 9164 - RNA, 22 nt, Human herpesvirus 1
ugcgugcuggacguccgcgacg

SEQ ID NO: 9165 - RNA, 22 nt, Human herpesvirus 1
cgaugucugucagguacguuug

SEQ ID NO: 9166 - RNA, 22 nt, Human herpesvirus 1
uccgggugcgccaccugguggu

SEQ ID NO: 9167 - RNA, 19 nt, Human herpesvirus 1
gccuggcgcgccgcggcuc

SEQ ID NO: 9168 - RNA, 22 nt, Human herpesvirus 1
uccgggugcgccaccugguggu

SEQ ID NO: 9169 - RNA, 19 nt, Human herpesvirus 1
gccuggcgcgccgcggcuc

SEQ ID NO: 9170 - RNA, 22 nt, Human herpesvirus 1
ucgugugguacaccgucuucgg

SEQ ID NO: 9171 - RNA, 18 nt, Human herpesvirus 1
accgauguauuuacgcgg

SEQ ID NO: 9172 - RNA, 22 nt, Human herpesvirus 1
ucggggggcgaaccggccgccu

SEQ ID NO: 9173 - RNA, 20 nt, Human herpesvirus 1
gccggcggcgcuccucgccg

SEQ ID NO: 9174 - RNA, 22 nt, Human herpesvirus 1
ucacgcugcaggugcuggccca

SEQ ID NO: 9175 - RNA, 22 nt, Human herpesvirus 1
ccgaacgcacaacggcgcugcu

SEQ ID NO: 9176 - RNA, 22 nt, Human herpesvirus 1
ucgggguccacgcgggccgcgg

SEQ ID NO: 9177 - RNA, 16 nt, Human herpesvirus 1
gcagccagagccccgc

SEQ ID NO: 9178 - RNA, 22 nt, Human herpesvirus 1
uacgccuacgccccaaugccca

SEQ ID NO: 9179 - RNA, 20 nt, Human herpesvirus 1
ugggugugacguugcguuua

SEQ ID NO: 9180 - RNA, 22 nt, Human herpesvirus 1
uggcgcagggccggcacgcccc

SEQ ID NO: 9181 - RNA, 22 nt, Human herpesvirus 1
uguaggacggccucgugguagu

SEQ ID NO: 9182 - RNA, 22 nt, Human herpesvirus 1
uuacccccccgccaguuucgug

SEQ ID NO: 9183 - RNA, 20 nt, Human herpesvirus 1
gagcuggcccaggaaguacg

SEQ ID NO: 9184 - RNA, 22 nt, Human herpesvirus 1
ugccgccgcgggaggauguguu

SEQ ID NO: 9185 - RNA, 16 nt, Human herpesvirus 1
cacccccgacgaggug

SEQ ID NO: 9186 - RNA, 22 nt, Human herpesvirus 1
uguguuuuggggggggcccguu

SEQ ID NO: 9187 - RNA, 14 nt, Human herpesvirus 1
uccccccgcuccuc

SEQ ID NO: 9188 - RNA, 22 nt, Human herpesvirus 1
uaaccacuccccugggguuccg

SEQ ID NO: 9189 - RNA, 21 nt, Human herpesvirus 1
uggcggaacacacggccccuc

SEQ ID NO: 9190 - RNA, 22 nt, Human herpesvirus 1
uaaccacuccccugggguuccg

SEQ ID NO: 9191 - RNA, 21 nt, Human herpesvirus 1
uggcggaacacacggccccuc

SEQ ID NO: 9192 - RNA, 22 nt, Human herpesvirus 1
uacggcgccgcggggauccucg

SEQ ID NO: 9193 - RNA, 20 nt, Human herpesvirus 1
cuguccgccgcgcccgccuc

SEQ ID NO: 9194 - RNA, 22 nt, Human herpesvirus 1
uacccguugcagcuguucaugc

SEQ ID NO: 9195 - RNA, 20 nt, Human herpesvirus 1
agagccguucaacgccaacc

SEQ ID NO: 9196 - RNA, 22 nt, Human herpesvirus 1
uacgagaagccaucgccuuccu

SEQ ID NO: 9197 - RNA, 20 nt, Human herpesvirus 1
aggaugccgguuucgacauu

SEQ ID NO: 9198 - RNA, 22 nt, Human herpesvirus 1
uauggcuccugcgacccgaaac

SEQ ID NO: 9199 - RNA, 21 nt, Human herpesvirus 1
ucggccccgcgucuggccccg

SEQ ID NO: 9200 - RNA, 22 nt, Human herpesvirus 1
ucaucgccauggacgcaaccgc

SEQ ID NO: 9201 - RNA, 20 nt, Human herpesvirus 1
guggacuuccugugcggucu

SEQ ID NO: 9202 - RNA, 22 nt, Human herpesvirus 1
ucuggcguuacugucggcacgc

SEQ ID NO: 9203 - RNA, 21 nt, Human herpesvirus 1
gacgucgccguggcgccccug

SEQ ID NO: 9204 - RNA, 22 nt, Human herpesvirus 1
uggcggccucaaguucgucggc

SEQ ID NO: 9205 - RNA, 21 nt, Human herpesvirus 1
ccgaugaccuuucccagcucc

SEQ ID NO: 9206 - RNA, 22 nt, Human herpesvirus 1
uggacaggcucuggagcauccg

SEQ ID NO: 9207 - RNA, 22 nt, Human herpesvirus 1
ugauauuaccggagaccuucug

SEQ ID NO: 9208 - RNA, 22 nt, Human herpesvirus 1
ugaagccccccgcaucgguggc

SEQ ID NO: 9209 - RNA, 22 nt, Human herpesvirus 1
cccccggaggcuuggggggcgg

SEQ ID NO: 9210 - RNA, 22 nt, Human herpesvirus 1
uguugucugggucaccauacac

SEQ ID NO: 9211 - RNA, 20 nt, Human herpesvirus 1
ucgggugucccggaccgucg

SEQ ID NO: 9212 - RNA, 22 nt, Human herpesvirus 1
uagcggcguugucucggaggug

SEQ ID NO: 9213 - RNA, 22 nt, Human herpesvirus 1
ccccgaccucggacgccacacc

SEQ ID NO: 9214 - RNA, 22 nt, Human herpesvirus 1
uucuugucgcuugcguaauaug

SEQ ID NO: 9215 - RNA, 22 nt, Human herpesvirus 1
gcacgucagccagucgauauau

SEQ ID NO: 9216 - RNA, 22 nt, Human herpesvirus 1
uuuggaaacuugccggucgccg

SEQ ID NO: 9217 - RNA, 22 nt, Human herpesvirus 1
gcgucccuccccgguuuccuuu

SEQ ID NO: 9218 - RNA, 22 nt, Human herpesvirus 1
uuucugggagaugccgugaacc

SEQ ID NO: 9219 - RNA, 22 nt, Human herpesvirus 1
ucaugcuggaguacuuuugccg

SEQ ID NO: 9220 - RNA, 22 nt, Human herpesvirus 1
uuuguucggggacaagcgcgcu

SEQ ID NO: 9221 - RNA, 17 nt, Human herpesvirus 1
uacucgucccagaauuu

SEQ ID NO: 9222 - RNA, 62 nt, Human
cucaugugugcagugguguaucaauaaagauagagaacgcuauugaaauuaccgugcaaaga

SEQ ID NO: 9223 - RNA, 62 nt, Human
ugaaccguaauuuggcuaaucagaggcauuuuuuuuguccuaguaucuuucacacuugucca

SEQ ID NO: 9224 - RNA, 62 nt, Human
uuaaauguaagcugaaacuggucuacugugucucuaggguuaagccaaaagacaaaaaaaau

SEQ ID NO: 9225 - RNA, 62 nt, Human
gagugagacaugccaaacauccaccuuugggaccauagcauaguuaaaauuaaauguaguug

SEQ ID NO: 9226 - RNA, 62 nt, Human
augauacuugaauuuuuugaaaugggcauuuauuuuauaacauguuaaaauguacuuuuuaa

SEQ ID NO: 9227 - RNA, 62 nt, Human
gucucuggucagcccuggagcaugggaucgugggaaagaggagggggaccaggcccagggca

SEQ ID NO: 9228 - RNA, 62 nt, Human; identical to SEQ ID NO: 9226

SEQ ID NO: 9229 - RNA, 62 nt, Human; identical to SEQ ID NO: 9227

SEQ ID NO: 9230 - RNA, 62 nt, Human
ucauagauggguggcaaaucuaagauuuguauaaagcauauaaaauagggugaucacccccg

SEQ ID NO: 9231 - RNA, 62 nt, Human
aaaagaagauuaaaaaguaaaagaaccacgaguaagauauuauuuaaauguugaaaucuuaa

SEQ ID NO: 9232 - RNA, 62 nt, Human
ucuccgcaacucucccgugaggcugcacccguguggguagcacuggaagcggcacuguuugc

SEQ ID NO: 9233 - RNA, 62 nt, Human
aaaacugccuuaaaauauucauaguuaauacagguauaucuauuuuuauuuacuuuguaaga

SEQ ID NO: 9234 - RNA, 62 nt, Human
gauucuggggugaggauacaaagacauugucuugcauauccauaagcaggucuuagagcauu

SEQ ID NO: 9235 - RNA, 62 nt, Human
aagccuagccaccucagcugcagggaggcagaaggcaaggcaggccccacggacacacuugg

SEQ ID NO: 9236 - RNA, 62 nt, Human
cuagacucugcuucacuuccugaagcuucaacuucaugucgaagauucacugggacccaauu

SEQ ID NO: 9237 - RNA, 62 nt, Human; identical to SEQ ID NO: 9235

SEQ ID NO: 9238 - RNA, 62 nt, Human
cucaguucauugaccagaugacagccacgugaugauuagggaaggacggaugcauugcgauu

SEQ ID NO: 9239 - RNA, 62 nt, Human
uauuuuuuuuuaaguaaaaauuuacuaaggccuuuagcauaauacuguaaaugucuuuuggu

SEQ ID NO: 9240 - RNA, 62 nt, Human
cccaagcaaaagaagagguugaguuugcugccaggauucagaucagcccuucccagggucug

SEQ ID NO: 9241 - RNA, 62 nt, Human
gaaauugauuggaauagaaacuuaaaggaaauggaacccuaacuauucucccaucaaaucau

SEQ ID NO: 9242 - RNA, 62 nt, Human; identical to SEQ ID NO: 9240

SEQ ID NO: 9243 - RNA, 62 nt, Human; identical to SEQ ID NO: 9241

SEQ ID NO: 9244 - RNA, 62 nt, Human
cucaggcccgugccugggaccccgugucugcccaggugggcagccuugagcccaggggacuc

SEQ ID NO: 9245 - RNA, 62 nt, Human
acgcggacuccgcgcgaccccggcccucucccugcggccgcagggcuuccccgccuggcgcc

SEQ ID NO: 9246 - RNA, 62 nt, Human
cugcacuuuguccacaaccuucccuucucuuucuauuccccagugaacugagguuuuuaccg

SEQ ID NO: 9247 - RNA, 62 nt, Human
augugagugggucugaagauacauucccaaauaaacgaccuaggcuagaagauaagacuguu

SEQ ID NO: 9248 - RNA, 62 nt, Human
ccccagcugccccagcacgcgggacccauagcacaccccuuagcgcuugccuagguugcuga

SEQ ID NO: 9249 - RNA, 62 nt, Human
uauuuuaaaauguaauccauuuuuacuucagcucauccaaaagcagccagcagaccgguuga

SEQ ID NO: 9250 - RNA, 58 nt, Human
gguggaacauggugcccugagccugcccccacccgccauccucucugcccucuugcua

SEQ ID NO: 9251 - RNA, 62 nt, Human
aaauaccgauaaaauggccuuaaguguauuccugacaguuaaauucagaaacgugccaaaug

SEQ ID NO: 9252 - RNA, 61 nt, Human
cccugcuggaccugcccuaggggcgggaagccagggccgcaccggcuuuccugcugcagau

SEQ ID NO: 9253 - RNA, 62 nt, Human
uuauguaucacuugcuaaaaauauuguuuuaaucagagauaaccucuuuaaaaaaauuuuua

SEQ ID NO: 9254 - RNA, 62 nt, Human
ccgccgcacccugcaccuuggaccggcauccguagccauggacagaggucccuggucuuccc

SEQ ID NO: 9255 - RNA, 60 nt, Human
auaucauuggaguacauucuaggugaguaguugccgcguagagacaauguuuucuuuuuc

SEQ ID NO: 9256 - RNA, 62 nt, Human
ccucccagcugcccgcccugugggcauuugcacauauccugacaagccugaaagaagcuccg

SEQ ID NO: 9257 - RNA, 62 nt, Human
uaccacucugguguagacagaggacuuuguccaagucucacacuaaacaugcccgggcuucg

SEQ ID NO: 9258 - RNA, 62 nt, Human
ugggaccccacacagcaauacgaguccaacuuaauaaacacauuucugggguuccucaggcu

SEQ ID NO: 9259 - RNA, 61 nt, Human
uugcacuauuacucagcagcaguaacaugguaacacuuaaaaugguacucggggaccucca

SEQ ID NO: 9260 - RNA, 62 nt, Human
gugacauggaauuggugucaggaccgccacguggccuucagaggaauccacagguccccacc

SEQ ID NO: 9261 - RNA, 60 nt, Human
guagcuccccccacgacaugucucccuuucuuagaauauauuaaagucagagucucugag

SEQ ID NO: 9262 - RNA, 62 nt, Human
cuaggggcgggaagccagggccgcaccggcuuuccugcugcagaucugggcugcgguggcca

SEQ ID NO: 9263 - RNA, 62 nt, Human
ccuuucuguggggguaccugugggguacuucaaacagcccuagcagcaaaggcccuugagca

SEQ ID NO: 9264 - RNA, 62 nt, Human
ggcugaagagccugaacugcaccuaacgggaaagaaccgacauggcugccuuuuguuuacac

SEQ ID NO: 9265 - RNA, 60 nt, Human
cacaaucuagcggagaaaggauguuacuagaaguacacaaauugggcccggcgcgauggc

SEQ ID NO: 9266 - RNA, 62 nt, Human
ucaggggugaauggcucuuuucacagagaguagccaaccagagaccuuugcuuugauaucau

SEQ ID NO: 9267 - RNA, 60 nt, Human
aagcgccugggagagccuagaccaggcuccgggcugccaauaaagaagugaaaugcguau

SEQ ID NO: 9268 - RNA, 62 nt, Human
cugcuucccagaaugcaccugacuuaugaaauggggauaauacucccaggaaauagcgcagg

SEQ ID NO: 9269 - RNA, 62 nt, Human
gccaucagaccuucuagggucuggcuggggucauccuagguaugggugaccgucccugagac

SEQ ID NO: 9270 - RNA, 62 nt, Human
gggggagggugaggcuuuguaccccagccccugcccaggccacugugagggugggugcuggc

SEQ ID NO: 9271 - RNA, 62 nt, Human
uugaguguggccaccugcaggaugugcagggcugccucagaagcuggcuggggacucuagcc

SEQ ID NO: 9272 - RNA, 62 nt, Human
agccccgagacagagaaccugcccacagcucuccccgcuacaggcugcaggcacugcagggc

SEQ ID NO: 9273 - RNA, 62 nt, Human
ggagggcaagugcuuguggaagcgggguuaaagccgggcgaaagaagcagaacagucuccgc

SEQ ID NO: 9274 - RNA, 62 nt, Human
acuugggccaugcacccccucucccccaaacacaaacaagcacuucuccaguauggugccag

SEQ ID NO: 9275 - RNA, 61 nt, Human
uggggaaagaaguugugaucuguugccuaaacuaaagcuuaaaaguuuaguaaaaaucguc

SEQ ID NO: 9276 - RNA, 62 nt, Human
gagaucccucggggcggggguguguggucaggcugggcaccaggcacacagauguccguggc

SEQ ID NO: 9277 - RNA, 62 nt, Human
agaagugacacuuucuuaaugcuuucaacccauucgacgcaauuucccguucaucucccaaa

SEQ ID NO: 9278 - RNA, 62 nt, Human
cugggauuacaggcaugagccaccucacuuggcccaauuuuaacuuaauuaucucugucaag

SEQ ID NO: 9279 - RNA, 58 nt, Human
ugauccaccugccucagccucccaaagugcugagauuacaggggugagucaccgcgcc

SEQ ID NO: 9280 - RNA, 62 nt, Human
cucacauuaaaagcaaauuuuuaauaucaggcucgaagagcaaaaugauuauuccucauguu

SEQ ID NO: 9281 - RNA, 58 nt, Human
aaucccaccacccuuugcugacucucuuuuugaacucagcccgccugcacccagguga

SEQ ID NO: 9282 - RNA, 62 nt, Human
accuugguuuuuguguuagauugagcugggcagcugcaaucagcuucuuuauaugcaaauua

SEQ ID NO: 9283 - RNA, 62 nt, Human
accaaguguuaauccugggaucguauuuuuauaucauauucacauauuuguuuuuuuaauug

SEQ ID NO: 9284 - RNA, 62 nt, Human
uguggcagcagcaggcuccccagcggcccagggugggccagaccagcagcccaggaagcagc

SEQ ID NO: 9285 - RNA, 62 nt, Human
ugcccuggggagcaaucccagcggaucgcuccgggccaccaagccgcaccugugccugagac

SEQ ID NO: 9286 - RNA, 62 nt, Human
guauuuucuuaaagcacgccuuuaaauaagcaaaaacuuuaaaaggcaggaaagagaauucu

SEQ ID NO: 9287 - RNA, 62 nt, Human
aauugaaauaucagcugagagauuauuugcugcuguuauucaaaaggccauuuaugaaguua

SEQ ID NO: 9288 - RNA, 62 nt, Human
guaguugauuacgagggagucaaauuuucuuuuuaaaaaggagcuucaaugauuuguaacug

SEQ ID NO: 9289 - RNA, 62 nt, Human
gcgcaccugcccuccuugcagcccagcacaccugcagguguaagggacgauuggaguuucuu

SEQ ID NO: 9290 - RNA, 62 nt, Human
ugcgagugugugggcuggugugugaauaucuauaaauaaguauauaugguguauauuauaug

SEQ ID NO: 9291 - RNA, 60 nt, Human
gaaucacccucgcuccgucaggcgggacucgugucccagagaggaaggggcugcugaggu

SEQ ID NO: 9292 - RNA, 62 nt, Human
ucaacaugggucagcacguucaguuacgggagugggaaauuacaugaggccugggccucugc

SEQ ID NO: 9293 - RNA, 62 nt, Human
uuuugcuguauagccuuagaugugcaaugcagacacuaucuaacugugugugguaaccuugc

SEQ ID NO: 9294 - RNA, 62 nt, Human
agacagcgacuccagagaaccucuugggagacagaagaggcaucugugcacagcucgaucuu

SEQ ID NO: 9295 - RNA, 62 nt, Human
guuuucucugauguauuuaaggugauguauuugcuugaguuacuccuguaucauugcucaua

SEQ ID NO: 9296 - RNA, 62 nt, Human
gggaagggugggaggggccccauccaaaggaugcccuggccagcgaggcugggucacagguc

SEQ ID NO: 9297 - RNA, 62 nt, Human
aagcuuggcggacccccagggccacacuguacccuccagcgagucccaggagagugacucug

SEQ ID NO: 9298 - RNA, 62 nt, Human
gugcaguggugcaugcacugucucagccaacccgcuccacuacccggcaggguacacauucg

SEQ ID NO: 9299 - RNA, 62 nt, Human
ccacugcuaguaaucaaggcuaacugguccagaaaucgcccaggagaaugaaauggauguuc

SEQ ID NO: 9300 - RNA, 49 nt, Human
cucauuucagacgaaaguaggcgguacgaacccuaauggaggcaguuuu

SEQ ID NO: 9301 - RNA, 62 nt, Human
uugacuuaaugcuuaaaaguauaucauaguuuucuuacggaaaagaucaguagaugagauug

SEQ ID NO: 9302 - RNA, 62 nt, Human
acacacacuuuuuuuguacuguagcaauuuuugaagaucuuaaauguuccuuuuuaaaaaaa

SEQ ID NO: 9303 - RNA, 62 nt, Human
uugaaaguugccuuuucucuccacccuugaguagauccaguauuugaugaaacucaugaaag

SEQ ID NO: 9304 - RNA, 62 nt, Human
gcaauggagugaguuucccaacuaagaaaccacuauuauauauuuuuucccuucagucacau

SEQ ID NO: 9305 - RNA, 59 nt, Human
ugguugaacaagggaaucacaagaaaacgaaaaugcaaaaacugaacuucgggggucgu

SEQ ID NO: 9306 - RNA, 62 nt, Human
gccugugucuggugggggccacucaggagaguuggguuuucagggcagagaugggcuugauu

SEQ ID NO: 9307 - RNA, 62 nt, Human
caggacacaguugauugucucuacagagcugugacgggggcacugagccccgcgggugucug

SEQ ID NO: 9308 - RNA, 62 nt, Human
aaauugagccauuuuuuuaaaguaauagauacuaauagauuaucuuuucugaugcacuggac

SEQ ID NO: 9309 - RNA, 62 nt, Human
gauguuguuccuuuuuugaaguugucauuaaaguaggugcaacaaccaagaaagugucucuu

SEQ ID NO: 9310 - RNA, 62 nt, Human
cgcgggucucugcucagcaccccagccggggcucuggacccaggguaacagccccaguucau

SEQ ID NO: 9311 - RNA, 62 nt, Human
gauguagaggucaggcugcugaaccagccaacacaugggcuacugcugggaagccugggcug

SEQ ID NO: 9312 - RNA, 62 nt, Human
ucuaacauuuacacuuuuguuauaagcuauuuaaaaccaguaaggagacuugaaauucagaa

SEQ ID NO: 9313 - RNA, 62 nt, Human
cucucgauacguuuggucuuucaugcugaaaaauaaauaauaaagccugucccgugucuacu

SEQ ID NO: 9314 - RNA, 62 nt, Human
cugcaauuaggcauuggucaggggugaauggcucuuuucacagagaguagccaaccagagac

SEQ ID NO: 9315 - RNA, 62 nt, Human
ggaaaagaugcaaaaguguucagccaagugacguuuacuaaauagccaauaaagggcuggug

SEQ ID NO: 9316 - RNA, 62 nt, Human; identical to SEQ ID NO: 9314

SEQ ID NO: 9317 - RNA, 62 nt, Human; identical to SEQ ID NO: 9315

SEQ ID NO: 9318 - RNA, 62 nt, Human
guaagguguacauaccuguacaguuuuggucaucugcgguaaguucuaugguauuuauuggc

SEQ ID NO: 9319 - RNA, 57 nt, Human
ccagccucuccucugcugagaauccccacuugguguagggggagaggggaaaggggu

SEQ ID NO: 9320 - RNA, 62 nt, Human
cugccuuguuugccccucagcgugccaggcagacugggggcaggacagccggaagcugagac

SEQ ID NO: 9321 - RNA, 62 nt, Human
cagccuccugaguagcugggauuacaggugugcaccaccguacccagcuaauuuuuguauuu

SEQ ID NO: 9322 - RNA, 62 nt, Human
acugcagguagggccuguuauguccaucauugcaugcguccauaccagggcugcaggccaag

SEQ ID NO: 9323 - RNA, 62 nt, Human
ucacacagccagucagaggauuguaaccugucugaccuuugaaggacccccugccuucaaag

SEQ ID NO: 9324 - RNA, 62 nt, Human
uuuauuuaaguuguauauaaauuugaguugaaacgagugcgauuugguuuguuuaucuucaa

SEQ ID NO: 9325 - RNA, 62 nt, Human
ucacccccgaggcagaggggccagcauuugcaaaggcacagagcuaagaggagcugggcaaa

SEQ ID NO: 9326 - RNA, 62 nt, Human; identical to SEQ ID NO: 9324

SEQ ID NO: 9327 - RNA, 62 nt, Human; identical to SEQ ID NO: 9325

SEQ ID NO: 9328 - RNA, 62 nt, Human
cucagcugcugggccccaccuccccacugcacccagggggcaacuccaccuggacugauggg

SEQ ID NO: 9329 - RNA, 62 nt, Human
aaucccucugcaguuuuggggagaucagcugcaggauuuuaacaggaauguuuuggucauug

SEQ ID NO: 9330 - RNA, 62 nt, Human
accucagacauaaacaccccauuucuguaaacccaaauuauaugguuucuucugcgaaagag

SEQ ID NO: 9331 - RNA, 62 nt, Human
uucuccucugcugggagcuguaguuucuuaucaaaauagauauuguuccaccaucccccucc

SEQ ID NO: 9332 - RNA, 62 nt, Human
aagaggcgcggggccacacccgugaaccaugcagacggccgaagaagucuuaggcagggcgc

SEQ ID NO: 9333 - RNA, 62 nt, Human
caggacaacugaccugucuccuucacacaguccacgucaccacgaaucacacaacaaaaagg

SEQ ID NO: 9334 - RNA, 62 nt, Human
cuacuccuuccuguagagcagaaauuguauuuugcacgaacaugcaguuauugaagauuagg

SEQ ID NO: 9335 - RNA, 62 nt, Human
cccagcuuccacaaaagauuuggcucuaccuuggaucugcuaguaaauaacuaauaggcagg

SEQ ID NO: 9336 - RNA, 62 nt, Human
auuaaggaaaaaagcaaguuugaagagaccacauggggcguacuauuuuuauugagcccaaa

SEQ ID NO: 9337 - RNA, 62 nt, Human
aaaggcucggccgcagagccggggcccagcgaaucacgcagagaaaucuuacagaaaacagg

SEQ ID NO: 9338 - RNA, 62 nt, Human
gggccacggaacccggcaggggugucugaggccgcccugucagcuggccgguccaagccugu

SEQ ID NO: 9339 - RNA, 62 nt, Human
gaagauggaauuugaaggucacuuuuaaaauuaagucauugaugcugcuguuacagagugug

SEQ ID NO: 9340 - RNA, 62 nt, Human
ucuucaacuucguguccuggaucgccuucuucaccacggccagcgucuacgacggcaaguac

SEQ ID NO: 9341 - RNA, 62 nt, Human
aaggaaaaaagcaaguuugaagagaccacauggggcguacuauuuuuauugagcccaaaaac

SEQ ID NO: 9342 - RNA, 62 nt, Human
gccucaccugaagcugcuguuccuccuaucagcacacuaguauuaaauggguguuccauaau

SEQ ID NO: 9343 - RNA, 62 nt, Human
augacuugaaauaguuuaaggagcuaaacagccauaaacggaaacgccuccuucaugcagcg

SEQ ID NO: 9344 - RNA, 62 nt, Human
ugccgugggaucaugggcagggaaggcucugggggucggagacaccgcugcuuagcaccccc

SEQ ID NO: 9345 - RNA, 62 nt, Human
aggacugacuccugggggagaacagcauucccgccgccuccagccucuccccucuggcaggc

SEQ ID NO: 9346 - RNA, 62 nt, Human
gcagcaguguuuaucucuggccaguugucugguuuccauguauucuaggccagguaggcaac

SEQ ID NO: 9347 - RNA, 62 nt, Human
uggugugccaggcaccaggcugccucugcucuuggaaaacuaggaaaggggaucagaaacau

SEQ ID NO: 9348 - RNA, 62 nt, Human
agugagcucuaaauucucuuaaugaaaaauauuuucgugacauuauaacaauuuuuuuuaau

SEQ ID NO: 9349 - RNA, 62 nt, Human
cucggcguggauggcagccucaggacacacaccccugccucaaggugcugagcccccgccuu

SEQ ID NO: 9350 - RNA, 62 nt, Human
uggaaccaaacccuuccagcgucucugcucacuuagcuggcagugccuguccccagcagcca

SEQ ID NO: 9351 - RNA, 62 nt, Human
gugggugcccaggagccggcccgcagcaccugcacacacgaaguccggacccacgcagccuc

SEQ ID NO: 9352 - RNA, 62 nt, Human; identical to SEQ ID NO: 9350

SEQ ID NO: 9353 - RNA, 62 nt, Human; identical to SEQ ID NO: 9351

SEQ ID NO: 9354 - RNA, 62 nt, Human
ccguugaucugucucuaguuucuuucuguuauugcacuaugaaaaucaguuauauucuuuaa

SEQ ID NO: 9355 - RNA, 60 nt, Human
ucacuauaagaguacuuuauuuuaaauguucuuuaggagaacauuuugcuaaagcaugac

SEQ ID NO: 9356 - RNA, 62 nt, Human; identical to SEQ ID NO: 9304

SEQ ID NO: 9357 - RNA, 57 nt, Human
acuuauaguauuucuauaauuugauucauugccguaauagagccauguaggaaaugc

SEQ ID NO: 9358 - RNA, 62 nt, Human
gaccuugugauuguuacagcucccuuugaucaaagaaauauagcuuucaggcauaaaccugg

SEQ ID NO: 9359 - RNA, 62 nt, Human
auaaugauaacaauuaaaaggauauucuguggaugucacguauuuugaaaugauagaacuac

SEQ ID NO: 9360 - RNA, 62 nt, Human
ucggccacuaaccagaugcaaauccccacacucuuccccuuagcgcuugaccgugccuccca

SEQ ID NO: 9361 - RNA, 61 nt, Human
aggagaguagaaaccacagcucuuaguaguaauggcauacagucuagaggaccauucaugc

SEQ ID NO: 9362 - RNA, 62 nt, Human
uuagucaguagggugugaaaauucuacuucaagggguucggauuggugaucauggggauugg

SEQ ID NO: 9363 - RNA, 62 nt, Human
gggaggcugaggcggguggaucaccugagguuaggaguucgagaccagccuggccaacaugg

SEQ ID NO: 9364 - RNA, 62 nt, Human
ccaacaugguccuagcacugcacacucaguucugcucuaagaagcugcaauaaaguuuuuuu

SEQ ID NO: 9365 - RNA, 62 nt, Human
ggccuccugcccagagcucagcacaggcccugggagccccgagaagggaaggcaggauuugg

SEQ ID NO: 9366 - RNA, 62 nt, Human
ucucaaggaggcccggggcggagggggguucccgcgugcacacgagugcggcuggacgugcc

SEQ ID NO: 9367 - RNA, 59 nt, Human
ugaaauacacaggaggaacgccuuccgaaauaagguguaaaaacagauauuugacuuga

SEQ ID NO: 9368 - RNA, 62 nt, Human; identical to SEQ ID NO: 9366

SEQ ID NO: 9369 - RNA, 59 nt, Human; identical to SEQ ID NO: 9367

SEQ ID NO: 9370 - RNA, 62 nt, Human
caccaagcaccacucgcucaucaaggcggagaucaugggagacguccugcacaagucccugc

SEQ ID NO: 9371 - RNA, 62 nt, Human; identical to SEQ ID NO: 9321

SEQ ID NO: 9372 - RNA, 62 nt, Human
uuccagcaucuuguacagcaaauccugacucgugucuuuuuacccccaagauaucugucuuc

SEQ ID NO: 9373 - RNA, 62 nt, Human
cugcaaacacaacugcucaggccuucucacgcguuuccacaacauccccugggucagaccca

SEQ ID NO: 9374 - RNA, 62 nt, Human
guguguucuucaaccuggcaaauuguuuccucucaugggggaagccgagcucugaugaacuu

SEQ ID NO: 9375 - RNA, 62 nt, Human; identical to SEQ ID NO: 9321

SEQ ID NO: 9376 - RNA, 62 nt, Human
ggugcuagcaagggcgcuaguuccccucgcgucucgggaguagaugagccgggagucccgcg

SEQ ID NO: 9377 - RNA, 62 nt, Human
cucuccccgccucuccugccuuguuugccccucagcgugccaggcagacugggggcaggaca

SEQ ID NO: 9378 - RNA, 62 nt, Human
cauaggggccaauuucaaauaauaauuuuuuucccugauggaauuuaccuuaaucuguauau

SEQ ID NO: 9379 - RNA, 60 nt, Human
agagaauaaacuccuacgaaagcccuacauugagcuccaaucugcucggggugggacggg

SEQ ID NO: 9380 - RNA, 62 nt, Human
agugugggugagggucgaaaugccaaaggucuacuuuccagaaucaagugccuucugcaaau

SEQ ID NO: 9381 - RNA, 62 nt, Human
ugcggccucucuaggaagcuguuccuuucuaugcccaauagaagcaacaaggcccuagcugg

SEQ ID NO: 9382 - RNA, 62 nt, Human; identical to SEQ ID NO: 9354

SEQ ID NO: 9383 - RNA, 62 nt, Human
aggaugagaagggagcagggagaguuccagaaagggggaugaaauaggaguauuaaaaagcu

SEQ ID NO: 9384 - RNA, 62 nt, Human
caggagucagggaggagacucgcugggagugggagggcagcacgggcgugaaggucggagga

SEQ ID NO: 9385 - RNA, 62 nt, Human
gcgggcagccucgccguagggucaggggacagcucggcuucagugacagccaccaugugaag

SEQ ID NO: 9386 - RNA, 62 nt, Human
ccaggccgcccagcagcugcugugugaugagcaggccccacagaggcagaggcugcuggcug

SEQ ID NO: 9387 - RNA, 55 nt, Human
gacccugugucuccaacugcugcaccccaucccgacccugucuccgccaccucgc

SEQ ID NO: 9388 - RNA, 62 nt, Human
ccagcugcuaacuggccucaaaugaugcaugugaggucaggauucauugaguagaaugcccc

SEQ ID NO: 9389 - RNA, 62 nt, Human
cugaaucacccucgcuccgucaggcgggacucgugucccagagaggaaggggcugcugaggu

SEQ ID NO: 9390 - RNA, 62 nt, Human
cagaguccacauugccuguuaggggaacgggaaugcccgcgaacgaagaggauacuaaagag

SEQ ID NO: 9391 - RNA, 62 nt, Human
aaauauauauagaaauauauacgaacaaaacacacgcgcgcacacacacacauacacgaaag

SEQ ID NO: 9392 - RNA, 62 nt, Human; identical to SEQ ID NO: 9390

SEQ ID NO: 9393 - RNA, 62 nt, Human; identical to SEQ ID NO: 9391

SEQ ID NO: 9394 - RNA, 62 nt, Human
cuaucuuuuaaagccugaucuggugugaauaaucaacuaggaaaucuaaacuuggauaacac

SEQ ID NO: 9395 - RNA, 62 nt, Human
gcaaggggcaauggagugaguuucccaacuaagaaaccacuauuauauauuuuuucccuuca

SEQ ID NO: 9396 - RNA, 62 nt, Human
uuaaauuuuuagaagcaaaacuuauacaacauuaaaaugauaccaagucccuuuccauuuuu

SEQ ID NO: 9397 - RNA, 59 nt, Human
aucuuugggacugauucucaguggagggcuuagaucauacaaaaaucuuuauugggucc

SEQ ID NO: 9398 - RNA, 62 nt, Human
cuuagacaggggacaauuucuuuguaguuguucugauaauaaacuggguuccauguugcauu

SEQ ID NO: 9399 - RNA, 59 nt, Human
cagcuucacuccucaggaaguaccauggacagacgccuaccaggggugacaaagcagug

SEQ ID NO: 9400 - RNA, 62 nt, Human
gcagaacuguaaaaugcacaacuuuuguaaaugugguauacaggacaaacuagacggccgua

SEQ ID NO: 9401 - RNA, 62 nt, Human
uuuuuuggucacuccaguagcuccuggaaaaaaccuuaaaaaauguuuccuccaaaucugau

SEQ ID NO: 9402 - RNA, 62 nt, Human; identical to SEQ ID NO: 9322

SEQ ID NO: 9403 - RNA, 60 nt, Human
ugccugaggguggggugggauuugcagggucauuaucagaacaugaggauaacuuccuug

SEQ ID NO: 9404 - RNA, 62 nt, Human
cccuccugcccugggcacugccuccaugcagaagcgcuucgagguucuggggcuaaaggccu

SEQ ID NO: 9405 - RNA, 62 nt, Human
aucuuuucuuuccuauccuuucuuccccccucacugugaaaaauaacaguccaccccaaguc

SEQ ID NO: 9406 - RNA, 62 nt, Human
cggcacaaaacugccuuaaaauauucauaguuaauacagguauaucuauuuuuauuuacuuu

SEQ ID NO: 9407 - RNA, 62 nt, Human
aaaaacucuccaaguguauuuauuuauauuuuuuuuaauagagacgaggucuugcuauguug

SEQ ID NO: 9408 - RNA, 62 nt, Human
gacccuggacacucaagccaaaguuaggccacaccaggcccaacccugugcuggucaagcca

SEQ ID NO: 9409 - RNA, 61 nt, Human
augcaugugauacucaucuccauuuuguuuccuugauugcauuuuuguucuuuuagcagau

SEQ ID NO: 9410 - RNA, 62 nt, Human
uguuguacaaucaggaaaagcaauaaagauuuuucaaaaauagacaugucaagaaaguuugc

SEQ ID NO: 9411 - RNA, 60 nt, Human
ugugugggcuggugugugaauaucuauaaauaaguauauaugguguauauuauaugugua

SEQ ID NO: 9412 - RNA, 62 nt, Human
ccuuucuuucucugggaucccugcccagcaccuuccuauagagaugacuuuaaaaggaaaaa

SEQ ID NO: 9413 - RNA, 61 nt, Human
uggauucaucaccugucaugcauugacaccugauacccagacuuaauugguauuuguucuu

SEQ ID NO: 9414 - RNA, 62 nt, Human
uggcccugccgagauuucaggauaaguuacccccaggcccgaagccccagcuugcccuggcc

SEQ ID NO: 9415 - RNA, 60 nt, Human
gcaccaguuccccgagggacgcagcaggccgccucccgcagcggccgugggucugcacag

SEQ ID NO: 9416 - RNA, 62 nt, Human
uucuuaacagucuccaaucccaucuauucucugccuuuacuauauguugaccauuccaaagu

SEQ ID NO: 9417 - RNA, 62 nt, Human
gagaccuugggccuuuggccuguggggcacuggggaugguaaccucacugccccgucacucc

SEQ ID NO: 9418 - RNA, 62 nt, Human
cucuugccauggccucaggucuugagggaaggcucgggccuagguuucuggacugcaaaggg

SEQ ID NO: 9419 - RNA, 62 nt, Human
aagcagguuucauaaagaaauucuuaaccuuagaaccucggauauccucuauguuuuaguuu

SEQ ID NO: 9420 - RNA, 62 nt, Human
aggccccguccccagcagagcgagaggugggagacucgcggacgccucucccugcagucccc

SEQ ID NO: 9421 - RNA, 61 nt, Human
gaccauggaauugcacugcagcaugggcaacaagagucaaacucccucuaaaaaaaaaaaa

SEQ ID NO: 9422 - RNA, 62 nt, Human
uauuucaguuggguaucuuuuuaaguaaaaacaacaaauaaacucuguacauguaaaacgug

SEQ ID NO: 9423 - RNA, 62 nt, Human
uauaucagaacguccuguaaucauuuaguuagaaacuaacuacuaacuagucuuuggaauuc

SEQ ID NO: 9424 - RNA, 62 nt, Human
gagauaccuggagcgacggccagacucugcaccccgacgccagagcccaaaccacugaccca

SEQ ID NO: 9425 - RNA, 62 nt, Human
ggucaggggugaauggcucuuuucacagagaguagccaaccagagaccuuugcuuugauauc

SEQ ID NO: 9426 - RNA, 62 nt, Human
uuauugcacuccagcccgggcgacagagcgagacuccaucuaccagauccuuaugacgcagc

SEQ ID NO: 9427 - RNA, 62 nt, Human
gugcggaggcucaggaggaauuccugcggguccucggcuccaugugccagaggcuccggucc

SEQ ID NO: 9428 - RNA, 62 nt, Human
guagagcagaaauuguauuuugcacgaacaugcaguuauugaagauuaggaucaaggauaga

SEQ ID NO: 9429 - RNA, 62 nt, Human
gauccuggagcccccgcaccgguaccacauccaccggcgaaagagcuuugacgccucugaca

SEQ ID NO: 9430 - RNA, 62 nt, Human
caguuccuccggaauaacagucccacuguuaaccuggugcuacugggaaguuccacacagua

SEQ ID NO: 9431 - RNA, 62 nt, Human
gacaaaucgcucuagcucagaaguugcagagcagccugggcaacauggugaaacccgucucu

SEQ ID NO: 9432 - RNA, 62 nt, Human
cguguggaacuguacaaauauuuauaccaaaaauauagauaagaaaagguggggcuauacua

SEQ ID NO: 9433 - RNA, 62 nt, Human
ucuguuggaucacgggaaaucaagacacccaggaggaauugaaagaggcuuccucuucucag

SEQ ID NO: 9434 - RNA, 62 nt, Human
gucacacuucuguccaccuggccuccucucgccuggccgccagccccagccccagccccagc

SEQ ID NO: 9435 - RNA, 62 nt, Human
cuuuccuggaucuuguagugggugcacacgcgugcacugggaccccacacagcaauacgagu

SEQ ID NO: 9436 - RNA, 62 nt, Human
guuaaugaacagccauacguguaagcuuuuucuugaguguuaagucuuuuaccaaaaguguc

SEQ ID NO: 9437 - RNA, 62 nt, Human
aguccaacagggacaucacucgccugccucugugugcgugcauguguguguguggugggggg

SEQ ID NO: 9438 - RNA, 62 nt, Human
uccugccugcccccacucaccccagacgcuucggaugcugcagcuccuggauaaucuccaca

SEQ ID NO: 9439 - RNA, 62 nt, Human
caugaccucccacccuaggagggagggaaggacaccguccuaggguauaaccuggcaauaaa

SEQ ID NO: 9440 - RNA, 62 nt, Human
cuggggcuucccaagagccuguggcuguggugccgggcuccagacacuucacggaaggaaga

SEQ ID NO: 9441 - RNA, 62 nt, Human
gcgucugucccuggccgcccucccucugcggucucggcgcaacagcagcgcccgcugacgcu

SEQ ID NO: 9442 - RNA, 62 nt, Human
ucugucggcacgagucccgcgggcagccucgccguagggucaggggacagcucggcuucagu

SEQ ID NO: 9443 - RNA, 55 nt, Human
caaccuuggugacagcagcgcagugccaaugcugaucacacugcaugggagauuu

SEQ ID NO: 9444 - RNA, 62 nt, Human
caggagguuugcacaagccgggcgauuuguuuguaacuagcagugggagaucaaguugggga

SEQ ID NO: 9445 - RNA, 60 nt, Human
agucccuaggacauaguaaaugauucauauauccgaacuacuguuauaauuauuccuucu

SEQ ID NO: 9446 - RNA, 62 nt, Human
agagaucacucaaaugauuuuuauaaugaaaugacaagaauaacccuuuugguaaccguauu

SEQ ID NO: 9447 - RNA, 55 nt, Human
agcuaauuucccauuuacaacacagaaaugauauagagcuaguucgcuccaacuc

SEQ ID NO: 9448 - RNA, 62 nt, Human
ucugucuaacuuggcuggugguguggaccccacugccugcuagggaauaccagcgcuucccc

SEQ ID NO: 9449 - RNA, 59 nt, Human
ggagggcagcaccugcuggggacgguggcccugccuucaugcccaggacaccagcuggg

SEQ ID NO: 9450 - RNA, 62 nt, Human
ugaccuuugaugguugagaaggguuuggacagaaaauugacaugaaaagaucuggcucaugg

SEQ ID NO: 9451 - RNA, 59 nt, Human
gcauacauaugauuuuuuuuuuucauuuaaguguuggaagaugcuaccuaacagccacg

SEQ ID NO: 9452 - RNA, 62 nt, Human
agacuacuucaauuaguuccccuacuacacuuugcuagugaaacugcccaggcaaagugcac

SEQ ID NO: 9453 - RNA, 62 nt, Human
ugcuugugaucagcuuugacaacagugacagccccacaacuaguagccaccuguacauuugu

SEQ ID NO: 9454 - RNA, 62 nt, Human
cguaaacaugaauuuuuuuucaauguagccccuggggaaugaaugaaauuuugagcuucuuc

SEQ ID NO: 9455 - RNA, 62 nt, Human
guugagauuucaagucucuugucaccauccucacacaugacaacaaaacccauaaugcauaa

SEQ ID NO: 9456 - RNA, 62 nt, Human
cuccccauacuuccugggaugaugugugaaaccugacaccuagauuuauuuggaaauauucu

SEQ ID NO: 9457 - RNA, 54 nt, Human
gcuguaaaaggcacaggggacucuggccugcggaggccagaaaauguaucggga

SEQ ID NO: 9458 - RNA, 62 nt, Human; identical to SEQ ID NO: 9410

SEQ ID NO: 9459 - RNA, 58 nt, Human
ucauaaaugggaauagaacgugaaagccagcucuuucagaauauccucuauuaauacu

SEQ ID NO: 9460 - RNA, 62 nt, Human; identical to SEQ ID NO: 9410

SEQ ID NO: 9461 - RNA, 58 nt, Human; identical to SEQ ID NO: 9459

SEQ ID NO: 9462 - RNA, 62 nt, Human; identical to SEQ ID NO: 9428

SEQ ID NO: 9463 - RNA, 61 nt, Human
gugggccccuuucccuuaggauggguaucaauucaacaauauuuauaaggcauuuacugug

SEQ ID NO: 9464 - RNA, 62 nt, Human
gagccacugcgcccagccugaaucauuucuuauaccuucugacagcccaacuuccagaggac

SEQ ID NO: 9465 - RNA, 60 nt, Human
uuuuucuuuuagaacuguauaguauugaaaaagaaaucaaauguaaaugucugguuuuca

SEQ ID NO: 9466 - RNA, 62 nt, Human
agguugccggggguagggguggggccacacaaaucuccaggagccaccacucaacacaaugg

SEQ ID NO: 9467 - RNA, 60 nt, Human
gaucuguacauagagaaauauuuaaauuuuuagaagcaaaacuuauacaacauuaaaaug

SEQ ID NO: 9468 - RNA, 62 nt, Human
ccacggccagcgucuacgacggcaaguaccugccugcggccaacaugauggcugggcugagc

SEQ ID NO: 9469 - RNA, 51 nt, Human
gggcagucacagcugcuuggggcccacagcacugcugccuggucuccacag

SEQ ID NO: 9470 - RNA, 62 nt, Human
ugaggagaaaagcaacccuguuucaaauccacugccaauucagcuccucuggaguggagcuu

SEQ ID NO: 9471 - RNA, 62 nt, Human
gaacagcuaucacguugaaccacgugaaacugcuguuuucuaggccaaaaauggugagcgau

SEQ ID NO: 9472 - RNA, 62 nt, Human
aaugacagccugcauuugcuagacgguuggugaguggcaucaaaugugugacuuacuaucuu

SEQ ID NO: 9473 - RNA, 53 nt, Human
ccagacagccacaaccagcccagccaccauccagugccuggggccuggccacu

SEQ ID NO: 9474 - RNA, 62 nt, Human
gcagccgccugcccugaggcugccccggugaauguuauuggaauucaucccucgugcacauc

SEQ ID NO: 9475 - RNA, 62 nt, Human
uguguccagcuucuuggccaccuuucccuggggacccuaacaggcccagagcagagccccuu

SEQ ID NO: 9476 - RNA, 62 nt, Human; identical to SEQ ID NO: 9374

SEQ ID NO: 9477 - RNA, 62 nt, Human; identical to SEQ ID NO: 9321

SEQ ID NO: 9478 - RNA, 62 nt, Human
ccugcgccagccccaggcugcugaggagcagaggccagaccagggccgaucuggguguccug

SEQ ID NO: 9479 - RNA, 60 nt, Human
ugccacugcgcucggccucagauuccauauuugaacaccagcugauugagagaaggggaa

SEQ ID NO: 9480 - RNA, 62 nt, Human
cagcuuaaagaugggaauucagguaugaaagaaaacaggcaaggaggcacugagggagaaag

SEQ ID NO: 9481 - RNA, 62 nt, Human
caaacuaauuaugcacacagaaaaucuguggagccuaucagaccccaagugucuugaaaugu

SEQ ID NO: 9482 - RNA, 62 nt, Human
cccagccucgcccgacagagcccggggcgcaggcgggcgccagggcgcuaaucccggcgcgg

SEQ ID NO: 9483 - RNA, 62 nt, Human
gauccuuccgguggagugucggagaagagagcuugccgacgaugccuuccugugcagagcuu

SEQ ID NO: 9484 - RNA, 62 nt, Human
ggccauguaacugugcagcauggacagggaugcgacggggcagcuggcuguguccauggcca

SEQ ID NO: 9485 - RNA, 62 nt, Human
ccucccccguccuggagguuccccagccccacuuaccgcguaaugcgccaauaaaccaauga

SEQ ID NO: 9486 - RNA, 62 nt, Human
acugcacuccggccuaggcaacgagagcaaaacuccaauacaaacaaacaaacaaacaccug

SEQ ID NO: 9487 - RNA, 62 nt, Human
aauuccauccuguaaagaacaggagucaggagccgcuggcaagagacagcaugucaccuggg

SEQ ID NO: 9488 - RNA, 62 nt, Human
uucucuacuguaaagugauuuuguuugcagguaagaaaauaauagaugacucaccacaccuc

SEQ ID NO: 9489 - RNA, 60 nt, Human
cgggaggcuggacagaggcugcuugucuggucuucgcccaaggcuccccugugagccgug

SEQ ID NO: 9490 - RNA, 62 nt, Human
gaugaauguuucccuuguacagaucccagcuuauggccuugacccagccguccucacagaug

SEQ ID NO: 9491 - RNA, 62 nt, Human
ugacauucggccucauccauaggguccugaagcugcaguccacagcucagaaaggagaggug

SEQ ID NO: 9492 - RNA, 62 nt, Human
uaucagcaccuuccuaguuugggauuugaaaaguggaauuaauugcaguagggauaaaguag

SEQ ID NO: 9493 - RNA, 61 nt, Human
uuuuaggaucuguacauagagaaauauuuaaauuuuuagaagcaaaacuuauacaacauua

SEQ ID NO: 9494 - RNA, 62 nt, Human
ccgcuuccccaugagcgucugcaaaacacuugccugaauacauaucacguauuuuagacucg

SEQ ID NO: 9495 - RNA, 62 nt, Human
cuuucagaaugucuccuggcauccuaaccauguaauaugacaauugggggugggguugaaau

SEQ ID NO: 9496 - RNA, 62 nt, Human
ccugcugucuucccuucuggccucugcacagggguggugacaguggcuacaggcugggcccc

SEQ ID NO: 9497 - RNA, 62 nt, Human
ccacugaagccacccuccgcccggacucaacagccgccagcaagcucgccuggcagugcccc

SEQ ID NO: 9498 - RNA, 62 nt, Human
gggagacuggguacaagggugaaaaguaguucccauaauacacaugguugacuauggugauc

SEQ ID NO: 9499 - RNA, 61 nt, Human
cuucugagcaucaguggugugggggaguaggugacgaaacacuagaccucuccugagagag

SEQ ID NO: 9500 - RNA, 62 nt, Human
ucgucauacaaugccugaucaugcugcuccugucacccuccacgauuccacagaccaggaca

SEQ ID NO: 9501 - RNA, 62 nt, Human
cggaagaggccccaauggggcggugaccccagccucgcccgacagagcccggggcgcaggcg

SEQ ID NO: 9502 - RNA, 62 nt, Human
acgcgugcgcagccaggccucgccagggugcggugcagagcagagcaggcaggggugggggc

SEQ ID NO: 9503 - RNA, 62 nt, Human
cugccgugugccaucuuuccuggaucuuguagugggugcacacgcgugcacugggaccccac

SEQ ID NO: 9504 - RNA, 62 nt, Human
auauauuguauauauuaaaacagagauaugugcaugaaaucaagaaaaaagaaaugaacaaa

SEQ ID NO: 9505 - RNA, 61 nt, Human
uuuauaauuucuugaacaggcaaaugaaagcuuauuauagaaugcauguauuuucuuuuau

SEQ ID NO: 9506 - RNA, 62 nt, Human
ucucagacacucauuccauacugcaccguacaugccagcguacccauugcaccgaaagcagg

SEQ ID NO: 9507 - RNA, 61 nt, Human
acuuguaucgguucuuaauuaaauuauccaaaacggaggcauuuaaacacuuggauuuaca

SEQ ID NO: 9508 - RNA, 62 nt, Human
guccuggccguccacagggucggcccucagcucagcccgccaggagucagggaggagacucg

SEQ ID NO: 9509 - RNA, 62 nt, Human
ugcucugcugcaggagagggggcuaaggggcuggauccaccaaggcagcucacagcgggaaa

SEQ ID NO: 9510 - RNA, 62 nt, Human
agcagcccacagcuguggggcuucagcagccacaccagcccagcccagcccagcucucgaua

SEQ ID NO: 9511 - RNA, 61 nt, Human
uuuaugcaggugcuagaaacuuuaugucaaaguggccacaagauuguuuaauaggagacga

SEQ ID NO: 9512 - RNA, 62 nt, Human
aaggcuucugaagaagaggaagggcgaguaggggcaccuggacgcugaugguggccaggaug

SEQ ID NO: 9513 - RNA, 62 nt, Human
gaggccuggcaggcaggcuuggcaugguuggccggggcgggacguacacugggucgccgcua

SEQ ID NO: 9514 - RNA, 62 nt, Human
ccagcagaggccggggcccagcuccagaaccacccgcccccaccaugcguccugcucucaga

SEQ ID NO: 9515 - RNA, 53 nt, Human
uaggaauaacuccuuuucuacauccacgcuccauagagucucuccuuuucaga

SEQ ID NO: 9516 - RNA, 62 nt, Human
agcagccuccucuagccucugaugccuucccuccacggcccaggucuccucacucaaagucc

SEQ ID NO: 9517 - RNA, 60 nt, Human
ccucagccucccgaguagcuggaauuacaagugcgcacuaccacacccagcuaauuuuug

SEQ ID NO: 9518 - RNA, 62 nt, Human
gugucccaagcaguacccaggcuuugcagaccacgcggggcagggcuccacugaagccaccc

SEQ ID NO: 9519 - RNA, 62 nt, Human
ugccucagccucccaaguagcugggaugacaggcgcacaccaccacgcccagcaaauuuuuu

SEQ ID NO: 9520 - RNA, 62 nt, Human
ccgccacguggccuucagaggaauccacagguccccacccaagaucccucaauuauaugggg

SEQ ID NO: 9521 - RNA, 58 nt, Human
cccugcagggcaaugugggcaucuggaccuggggacgauguggaugcacuucuuggaa

SEQ ID NO: 9522 - RNA, 62 nt, Human
cacacacacacacacacacacacauacacagacaaaaacacaaaaacucugaggggaucugg

SEQ ID NO: 9523 - RNA, 62 nt, Human
aaaccaacacugugugggggccaaggucugauccuuauguuaauacaaggaagauuguuuac

SEQ ID NO: 9524 - RNA, 62 nt, Human
ccuacugccgcccagaaaaggggcagggcucugcagccgccaggacagacgagcaccccaug

SEQ ID NO: 9525 - RNA, 61 nt, Human
aaggaauuaggaaguuaagagaaggggaagaauauggaggauaggagagggugaugaugcu

SEQ ID NO: 9526 - RNA, 62 nt, Human; identical to SEQ ID NO: 9276

SEQ ID NO: 9527 - RNA, 62 nt, Human
cgcgcagacacacggacacgaacacgggacagacgccggcgaggcguggcagccucacaggg

SEQ ID NO: 9528 - RNA, 62 nt, Human
gaaccagggugaagucacaggucccgggguguggaggcuccauccuuucuccuuucugccag

SEQ ID NO: 9529 - RNA, 62 nt, Human
ugccccacccuagcugaucaauguacuuugcaaucucccccacccuuaagaagguucuuugu

SEQ ID NO: 9530 - RNA, 62 nt, Human
augaguauuucggagcaugagauagaauacauggaaacgcaaugaccgagaacuuuuaagag

SEQ ID NO: 9531 - RNA, 62 nt, Human
augagccacugcaccuggccgguuauucucucuuuacagauagcuauagacaucauuuuagg

SEQ ID NO: 9532 - RNA, 62 nt, Human
gaggcugaggcggguggaucaccugagguuaggaguucgagaccagccuggccaacauggua

SEQ ID NO: 9533 - RNA, 55 nt, Human
caaauuuuuaauaucaggcucgaagagcaaaaugauuauuccucauguuuuagcu

SEQ ID NO: 9534 - RNA, 62 nt, Human
ucauucuuacauacuucuguguuuaaauuuucauucuuaccaaaacaguuaacucuuucuuu

SEQ ID NO: 9535 - RNA, 62 nt, Human
ccuuucgggcaccaccagccauccccgagugcccuguagccacucaccacugcugccaccuc

SEQ ID NO: 9536 - RNA, 62 nt, Human
uuauuguuaaaaugcagaggaaucuggaaauauuuauauccacggaguccuuggauccagug

SEQ ID NO: 9537 - RNA, 62 nt, Human
uuccuaacuuccuggcaacaaccacaauuguaauucguucaaagagauugacugcuguggag

SEQ ID NO: 9538 - RNA, 62 nt, Human
gucacccuucaacgcucccagacggucaggaaaacuguuccaaucaugaaaaggggggauga

SEQ ID NO: 9539 - RNA, 59 nt, Human
uuaacuaccaugauugcuuuugagggcccggaauuauaaauauauauuauauuuuaauu

SEQ ID NO: 9540 - RNA, 62 nt, Human
ucugguauauguucuuuugcuaaaugaaggcuuggaguuggagggaagaaggggagauggag

SEQ ID NO: 9541 - RNA, 62 nt, Human
ccgggacccuuucacugccccgguggagugaauagaggaugaggggcccugacccugugucu

SEQ ID NO: 9542 - RNA, 62 nt, Human
aagggggcagccuucucucuucccagugaugcacauccuucacauuggcugcuuuguucugg

SEQ ID NO: 9543 - RNA, 62 nt, Human
acuguugcugagucucugucucaugucguagaauuguggauaauugucuagugacccucuca

SEQ ID NO: 9544 - RNA, 62 nt, Human
gggaggcaggcaccgggcaugucggcgccucuggucaaaccaccuacacugccugggguggg

SEQ ID NO: 9545 - RNA, 60 nt, Human
aguaaccuacugccugagaucaugaucucuuaaaagaugagacucucggaaggguugauu

SEQ ID NO: 9546 - RNA, 62 nt, Human
ucaauagcugccuuccucaccgcagauguuucugccucuuaaggauagaucuucugcaacag

SEQ ID NO: 9547 - RNA, 62 nt, Human
guaaucagauuuccaacuuaugccuuccagaaaaaaacacuacugccuaacacaaaucugug

SEQ ID NO: 9548 - RNA, 62 nt, Human
aguguucuugcucugacagaauauuaaucuuguacgcuuggauugaguuauuuaauuuuuuu

SEQ ID NO: 9549 - RNA, 62 nt, Human
ugccccugcccugagaaggagccccagacuuaccgauguagacgcugcccuuggcguugacu

SEQ ID NO: 9550 - RNA, 62 nt, Human
uagaauuguggauaauugucuagugacccucucaucacuguaaccaucgcgccuggccuaga

SEQ ID NO: 9551 - RNA, 62 nt, Human
cuagaaauggucaaggaauucauuuggcuccuugauacaucaguccucaauauuacuuucua

SEQ ID NO: 9552 - RNA, 62 nt, Human
ccuggccgagaacgccgagccugaggagcaguccgcugcguaggcgucccacgcaggcccac

SEQ ID NO: 9553 - RNA, 62 nt, Human
cagcugucacucucucccacccccgggcagcuguuuugcccaagaccacugcuaccuguuua

SEQ ID NO: 9554 - RNA, 62 nt, Human
ccaaaucucauaaacuagccuucucaaaaucccagcaauauaaagcacuguuuuucuucagu

SEQ ID NO: 9555 - RNA, 57 nt, Human
gaggucaaaauuuaugaaaaacaaaaugcuguaugaauggaaaucauuuugcaauug

SEQ ID NO: 9556 - RNA, 62 nt, Human
agccaagccaauccuuuuucuuuuuuuuggaggucccaccgagauagauaggaacuuggauu

SEQ ID NO: 9557 - RNA, 61 nt, Human
cuccugcucucuggaggacggucaguccaugucucggagaaacgggugagcugagcuuggc

SEQ ID NO: 9558 - RNA, 62 nt, Human
gccagcucuuggcuaagaccaggaggcugcaagucuccuagaagcccucugagcuccagagg

SEQ ID NO: 9559 - RNA, 62 nt, Human
agaguucggcccccucuugaccugccucagggaggaucuggagucugucucaagcccacuag

SEQ ID NO: 9560 - RNA, 62 nt, Human
aaauguaaaugucugguuuucauauaauguuuaaaaagaccauugagaaggaggcuggcgcu

SEQ ID NO: 9561 - RNA, 57 nt, Human
cuaagccauauuuaucacccguggacagcacauccgagucaagacuguuaauuucug

SEQ ID NO: 9562 - RNA, 62 nt, Human
aaacugauuuguaacuaacacuggaccauuggaucgauauuauaugcuguaaccaugugucu

SEQ ID NO: 9563 - RNA, 62 nt, Human
cccacaacacucuaggugcagagccccuguggcaaaguauuacaggguguggguggggauua

SEQ ID NO: 9564 - RNA, 62 nt, Human
gagauacagcugugagagccggauccggaguuaccugagggaggugagccugagugaagacc

SEQ ID NO: 9565 - RNA, 57 nt, Human
uacccaugcuccgugugucugugucugcauguccacacgucugaugcaccuguguac

SEQ ID NO: 9566 - RNA, 62 nt, Human
ccucgaaggagcagccugggcagccaucacaccacgaggacaggaagcaccagcacguuuca

SEQ ID NO: 9567 - RNA, 58 nt, Human
augacuuauaaagcagcaacagcugaggcgcaccaggacacagcuuccauuucuuuaa

SEQ ID NO: 9568 - RNA, 62 nt, Human
gaagcauuuacuuagcucaagucugaagcuguagauacuggaagacaaugcaccuuggaggg

SEQ ID NO: 9569 - RNA, 62 nt, Human
augcccaaguugcccuuuaaaaaaaaagagcguaaauacaaacaggaguggugcaagccgcc

SEQ ID NO: 9570 - RNA, 62 nt, Human
aggggaggagcacaggccuucagauggggcuucccacguguagcuacugaucccauauuucc

SEQ ID NO: 9571 - RNA, 62 nt, Human
acugcaacgucccgucccuuccccacccccaucccauccccacccccagccccagcccaguc

SEQ ID NO: 9572 - RNA, 62 nt, Human
acguucacauuuacguagcugguugcuuacaaacgggccugagccccugguugggugggugg

SEQ ID NO: 9573 - RNA, 62 nt, Human
agaggcgcggggccacacccgugaaccaugcagacggccgaagaagucuuaggcagggcgcc

SEQ ID NO: 9574 - RNA, 62 nt, Human
caagccggccccccguaccccuugccugggagcaaaccgccaggacgcagccuccacgccgc

SEQ ID NO: 9575 - RNA, 62 nt, Human
cauauuuauauguucucucaaauguaugucucuuacguaacauacucuaagaaugaaacugu

SEQ ID NO: 9576 - RNA, 62 nt, Human
aaauuucagaaaauuuaguuagauaaaagccgaccgaacccaugcuacaaagaacuuuuugu

SEQ ID NO: 9577 - RNA, 62 nt, Human
cuaagggccuccaccagcauccgagcaggaucaagggccggaaauaaaggcuguuguaaaga

SEQ ID NO: 9578 - RNA, 62 nt, Human; identical to SEQ ID NO: 9518

SEQ ID NO: 9579 - RNA, 62 nt, Human
auaaagauaauuguauuuuauguuuugcacacaaacgcagaauuuguauaaccauaugacuu

SEQ ID NO: 9580 - RNA, 62 nt, Human
auaaccuccccuaaacaccaccuagguauuuguuagaagucacacuauuacuccaaugucau

SEQ ID NO: 9581 - RNA, 58 nt, Human
gugguugaaagugaacugcuguuugccugauugguaaaccaacacacuacaauugaua

SEQ ID NO: 9582 - RNA, 56 nt, Human
aacccuuggugugggucugaggucuugacucaacgagagcacuugaaaaugaaaug

SEQ ID NO: 9583 - RNA, 62 nt, Human
ugcccauuuauuuccaaccccaacagacacugacaggguccauggaauucuucgggaaaucc

SEQ ID NO: 9584 - RNA, 62 nt, Human
agaccaaaaugacaaugaugaugauaaugaugaugacgacgacaacgaugaugcuuguaaca

SEQ ID NO: 9585 - RNA, 59 nt, Human
gcacuccggccuaggcaacgagagcaaaacuccaauacaaacaaacaaacaaacaccug

SEQ ID NO: 9586 - RNA, 62 nt, Human
gguaugggugaccgucccugagacauaagcgagguagauucagccauccucacccucagacu

SEQ ID NO: 9587 - RNA, 62 nt, Human
uguaagugacuaaccaagauuauuucauuuuaaaaccauagaauaaaaaugacaccugagcu

SEQ ID NO: 9588 - RNA, 62 nt, Human
caggaccgccacguggccuucagaggaauccacagguccccacccaagaucccucaauuaua

SEQ ID NO: 9589 - RNA, 62 nt, Human
aucacccaccaaaguuagcugaaagcagggcacuccuggauaaagcagcuucacucaacucu

SEQ ID NO: 9590 - RNA, 62 nt, Human
gcuggguauggccuuuggggcggccggcccgggagggucuuagucuaauuagguguguccag

SEQ ID NO: 9591 - RNA, 62 nt, Human
ccgacuuagcaaaugggaccgguccccagggucaggcucuuagagcaggcacaagacuggga

SEQ ID NO: 9592 - RNA, 62 nt, Human
cucccaccucccaccugaccccagcggcuccgguguccuccacguggcugcccuggggagca

SEQ ID NO: 9593 - RNA, 62 nt, Human
aucccagaaacauugagccaucagaaugaacuguguaccugauuuguucucugaccuggcua

SEQ ID NO: 9594 - RNA, 62 nt, Human
uacacccgucaccugggucugccgggauggguugggggggcaggugccaggccucacugcug

SEQ ID NO: 9595 - RNA, 59 nt, Human
cuggccguccacagggucggcccucagcucagcccgccaggagucagggaggagacucg

SEQ ID NO: 9596 - RNA, 62 nt, Human
agaaucuuuuuuccccucucccccuuccugacccuacuugcacugcuguggauuuuuuuaag

SEQ ID NO: 9597 - RNA, 62 nt, Human
aagcuagacucuacccucuaaggguuuagauuuuuugugggauuuuuuuuuuccucauuuuu

SEQ ID NO: 9598 - RNA, 62 nt, Human
ucaggaccacccucgccaagcuccaggguaccugccccucuaacccacuucaaauuacaagu

SEQ ID NO: 9599 - RNA, 62 nt, Human
ggccuccugggaauaacaccauccccaaucaugacaaccaaaaaugucugcagacacugcca

SEQ ID NO: 9600 - RNA, 62 nt, Human; identical to SEQ ID NO: 9598

SEQ ID NO: 9601 - RNA, 62 nt, Human; identical to SEQ ID NO: 9599

SEQ ID NO: 9602 - RNA, 62 nt, Human
cagugacgugacucagagcugcaggggugguuucuacggugaucugagugucucugccugga

SEQ ID NO: 9603 - RNA, 61 nt, Human
ggguugcugggcauuugaaggcaggaagauuuuuaaagauagauugagguugguuuaaaau

SEQ ID NO: 9604 - RNA, 62 nt, Human
gaaagcaacuuuugaaauuuucuguuaaaauugucaaauauauuuuaugaagaauuuauaaa

SEQ ID NO: 9605 - RNA, 60 nt, Human
aaggcaaagauugaaaacaugcuuaaccacuagcaaucaagccacaggccuuauuucaua

SEQ ID NO: 9606 - RNA, 62 nt, Human
uuucccuccacagacaauguccucuguucaauuccuaacgcaaacuacaauaaauggugaca

SEQ ID NO: 9607 - RNA, 62 nt, Human
uauugacugcagagucuauuuaagcaugugguuuuaaaaauagacaguauuuuuuaaaaauc

SEQ ID NO: 9608 - RNA, 62 nt, Human
aagccuuuucccuggaaguguccaugccucaccugcaacccaugugguucucagacuugaau

SEQ ID NO: 9609 - RNA, 62 nt, Human
gcacuggcuguuaagauggggaagggguacaucaggauuccacucauagcccugguucguua

SEQ ID NO: 9610 - RNA, 62 nt, Human
ugccucagccucccgaguugcugggacuauaggugugcgccaccaugcccagcuaauuuugu

SEQ ID NO: 9611 - RNA, 62 nt, Human
uguggcaagugcacaccuggcaucccugcgucagaucgcgcaccuucaggucgcgcaccuuc

SEQ ID NO: 9612 - RNA, 62 nt, Human
aauuuuucuuucuuuuuuuuuguucguucauuuaaacguauauuuagaacugcacuuugucc

SEQ ID NO: 9613 - RNA, 62 nt, Human
gauuacagagggcucauuuucuacgucauguauuuuaugauacuugaauuuuuugaaauggg

SEQ ID NO: 9614 - RNA, 62 nt, Human
ggggguacgauguuuauacuccguaaagaacauacaaggacauucacugcugauuuuuuuuu

SEQ ID NO: 9615 - RNA, 62 nt, Human
cgcccucagccgcggagccucugcggaggcugagccccgcgaccggagcgccgcucuccgcu

SEQ ID NO: 9616 - RNA, 62 nt, Human
uccaccuuucccaagaguccugguugcacguuuuaagucauauauuuucgucccccugaaaa

SEQ ID NO: 9617 - RNA, 62 nt, Human
uuuucugucacugauccguauuaccacuuuuggaaaaaaauaaauaaauaaauaaauaaaag

SEQ ID NO: 9618 - RNA, 62 nt, Human
cuggccaacaugguaaaaccccaucucuacuaaaaauacagaaauuagccgggcgugguggc

SEQ ID NO: 9619 - RNA, 58 nt, Human
uggucgggauauuuacguggugccuggcuugaguaaaaaucugaagccagaugcuuca

SEQ ID NO: 9620 - RNA, 62 nt, Human
acuuaaauuuggagauuuucccccacaucucuuuuccggauacauuauaauucuggaccccu

SEQ ID NO: 9621 - RNA, 62 nt, Human
cugagacuaggaguccugaacugcugacgcgaaagaggcgcaguucccaauuaauacggaaa

SEQ ID NO: 9622 - RNA, 56 nt, Human
acucugauaccuccaacugaucucccagcaaucgcaucccggcugacccugugccc

SEQ ID NO: 9623 - RNA, 62 nt, Human
gcgggucguggggaccaagcacauugguccuaaaggggcugaagagccugaacugcaccuaa

SEQ ID NO: 9624 - RNA, 62 nt, Human
uccucgggcuccagggugcugcugcgggggucccggcgcugagccgggccccggggccgcgg

SEQ ID NO: 9625 - RNA, 61 nt, Human
guuccuggagcuagugguuaccugaacagguauggcgaugagcuacaacaucaccugaguc

SEQ ID NO: 9626 - RNA, 62 nt, Human
uaaacuuuguuguuuaaauuuguuaacuuuuuauauuaaugacuauugaaagugguaauaaa

SEQ ID NO: 9627 - RNA, 53 nt, Human
cuauugauuucccaccuuccagugaaauucugaaagucuuaucuuaaaaaucg

SEQ ID NO: 9628 - RNA, 62 nt, Human
cacggcuccgagggcggccagggacagacgcuugcgccgagaccgcagagggaagcgucagc

SEQ ID NO: 9629 - RNA, 62 nt, Human
ugugguuuggcuuuacugagauuccaaaccccacuaucugcacuccgugacagugguaugga

SEQ ID NO: 9630 - RNA, 62 nt, Human
gccugcagccucccacaugccuuaaggggaccguggcccccaccagggacguccugcgccau

SEQ ID NO: 9631 - RNA, 62 nt, Human
uggagucucgcucugucgcccaggcuggagugcaguggcgcaaucucagcucacugcaagcu

SEQ ID NO: 9632 - RNA, 62 nt, Human
agcuagaucaaaaucuggggacaaauucuccugcuaacugcaaguuaaaauaggcccuucuu

SEQ ID NO: 9633 - RNA, 60 nt, Human
caaggcaccgcuaagcaagcauugucugugccauaacacaguacuagaccacuuucuuac

SEQ ID NO: 9634 - RNA, 62 nt, Human
gugucaagccuagccaccucagcugcagggaggcagaaggcaaggcaggccccacggacaca

SEQ ID NO: 9635 - RNA, 60 nt, Human
agagaagacuuucagccucuugaucaccagcacgaccauacuguuucagaaagcugggug

SEQ ID NO: 9636 - RNA, 62 nt, Human
augcugggauuacagggguaagccacugugcccggccgguuauuucuuuaaaagguaaucau

SEQ ID NO: 9637 - RNA, 62 nt, Human
gaucaaaaucuggggacaaauucuccugcuaacugcaaguuaaaauaggcccuucuuacuga

SEQ ID NO: 9638 - RNA, 62 nt, Human
gggccgcagggacgacacucuccagggaggccccagcaaccacaccaucuucuugcugugag

SEQ ID NO: 9639 - RNA, 62 nt, Human
uaccucucguaacacagcaauacaguccucuugaggcacucaagccugagaggaagcucagg

SEQ ID NO: 9640 - RNA, 62 nt, Human
uuggugaguggcaucaaaugugugacuuacuaucuugggccagaacuaagaaugccaagguu

SEQ ID NO: 9641 - RNA, 62 nt, Human
ggcccuaucagugcugggcucugccuguagcagcuccugguaagaguuggggugggccuucc

SEQ ID NO: 9642 - RNA, 62 nt, Human; identical to SEQ ID NO: 9607

SEQ ID NO: 9643 - RNA, 60 nt, Human
ucucuuccgauagagucgcuauuucugguuaauauacauauauaaauauauaaauacaaa

SEQ ID NO: 9644 - RNA, 62 nt, Human; identical to SEQ ID NO: 9607

SEQ ID NO: 9645 - RNA, 60 nt, Human; identical to SEQ ID NO: 9643

SEQ ID NO: 9646 - RNA, 62 nt, Human
ugcuggaaaccaugcaaaauguuuugaauugcccuuaaaauauggaaaauguuuucugaaug

SEQ ID NO: 9647 - RNA, 62 nt, Human; identical to SEQ ID NO: 9523

SEQ ID NO: 9648 - RNA, 62 nt, Human
cgugaaagccagcucuuucagaauauccucuauuaauacugaauuuagauaucuuuauucca

SEQ ID NO: 9649 - RNA, 62 nt, Human
agugacacuucauuguaauucacaguguaaauuuaauccaaacugaaauuuuguuucaacug

SEQ ID NO: 9650 - RNA, 62 nt, Human
gaguuuagguaauuuucaaacauuaaauccaacuucaacggaaacaaauacacucaagggaa

SEQ ID NO: 9651 - RNA, 60 nt, Human
aaauguaaucuuuccaaugcuccaaugaauuuauacaugagauugauaugcaauaaaucu

SEQ ID NO: 9652 - RNA, 62 nt, Human
uugccugggagcaaaccgccaggacgcagccuccacgccgcaccugccacauucagcccugc

SEQ ID NO: 9653 - RNA, 62 nt, Human
cgaguagcugggauuacaggugcaugccaccauggcuggcuaauuuuuguauuuuuaguaga

SEQ ID NO: 9654 - RNA, 62 nt, Human
cccugauccuaacaggugugauuguuacguaagacgcugauacugggccuuguauugcuuuu

SEQ ID NO: 9655 - RNA, 62 nt, Human
cauccccuuucuggccaaacuagcucuuggaggaacgagcaaaacagaagcggugcauaccu

SEQ ID NO: 9656 - RNA, 62 nt, Human
auuuuuaaaacaggguacaacccccugcugcacacgcuagcauaucuggaaccuacuaugaa

SEQ ID NO: 9657 - RNA, 62 nt, Human; identical to SEQ ID NO: 9655

SEQ ID NO: 9658 - RNA, 62 nt, Human
gguucugucuuugucucuuccuuucaccucauucugguagcagcauaaagguuaggcaauca

SEQ ID NO: 9659 - RNA, 62 nt, Human; identical to SEQ ID NO: 9655

SEQ ID NO: 9660 - RNA, 62 nt, Human
ggugcaccugggagaaagacuuuguccccacuuacagaucuaucuccucccuugggaagggc

SEQ ID NO: 9661 - RNA, 60 nt, Human
auaaaaacuugcauccaacaugaauuuccagccgaugauaauccaggccaaagguuuagu

SEQ ID NO: 9662 - RNA, 62 nt, Human
cagugacuucaccugagaacaucccagcgggaggacaagagaaaucauguuuauuccucagg

SEQ ID NO: 9663 - RNA, 60 nt, Human
uaaaacuagugcacauugucugccauaagaaaaccacccacaagcucaacugugacccaa

SEQ ID NO: 9664 - RNA, 62 nt, Human
cucccaaagugcugggaugacaggugugagccacugcgcccagccugaaucauuucuuauac

SEQ ID NO: 9665 - RNA, 58 nt, Human
cgugaccguaucccucugccacaccccaggcccugcgaggggcuaucgagaggagcuc

SEQ ID NO: 9666 - RNA, 62 nt, Human; identical to SEQ ID NO: 9664

SEQ ID NO: 9667 - RNA, 58 nt, Human; identical to SEQ ID NO: 9665

SEQ ID NO: 9668 - RNA, 62 nt, Human; identical to SEQ ID NO: 9664

SEQ ID NO: 9669 - RNA, 58 nt, Human; identical to SEQ ID NO: 9665

SEQ ID NO: 9670 - RNA, 62 nt, Human; identical to SEQ ID NO: 9518

SEQ ID NO: 9671 - RNA, 60 nt, Human
ccgggugguccaggcuugcacugaagacgugccacggggaggcuccugcaggaggcucaa

SEQ ID NO: 9672 - RNA, 62 nt, Human; identical to SEQ ID NO: 9518

SEQ ID NO: 9673 - RNA, 60 nt, Human; identical to SEQ ID NO: 9671

SEQ ID NO: 9674 - RNA, 62 nt, Human
ucuguguauauauagaagguagaaaugaaaagugagaaaauauuugaaagggauuauauuaa

SEQ ID NO: 9675 - RNA, 62 nt, Human
gcuuuaaauuuucauaaacuggaauccuuucacccgcuccuacagcuaacccucacaagcau

SEQ ID NO: 9676 - RNA, 62 nt, Human; identical to SEQ ID NO: 9564

SEQ ID NO: 9677 - RNA, 62 nt, Human
gggacugaggcugcagcauuggaacaaaagagcauuauuucaauuuuucuuucuuuuuuuuu

SEQ ID NO: 9678 - RNA, 62 nt, Human
gucuacuuaaaaauguuucugggaaauucacuagaaacauuaaccaauaggauuuuggugag

SEQ ID NO: 9679 - RNA, 61 nt, Human
ccaccacaaccuccagccucccuuuucagagcacagcauuaaaguuuggggaauucuguag

SEQ ID NO: 9680 - RNA, 62 nt, Human
uuuuuuuuugagauguagucuuacucugucacccaggcuagagugcaauggcaccaucuugg

SEQ ID NO: 9681 - RNA, 60 nt, Human
gaaagagugaugacaacagcccagggagcagccccgcucagaacccaagucccaaguucc

SEQ ID NO: 9682 - RNA, 62 nt, Human
gggccgcacagcgcggcagggccuuggcuaccacacgcggcaucgcuccuuggggugcaugg

SEQ ID NO: 9683 - RNA, 62 nt, Human
cccuagacugaguucuggcagcuccccgaggcagccgggguacccucuagauucagggaugc

SEQ ID NO: 9684 - RNA, 62 nt, Human
ccucccaccgcuuuauuucuuucgguuucggaugcaaaacaaaaaauuuuaaaagaaaaugu

SEQ ID NO: 9685 - RNA, 61 nt, Human
acccuggacacucaagccaaaguuaggccacaccaggcccaacccugugcuggucaagcca

SEQ ID NO: 9686 - RNA, 62 nt, Human
uauucagguuucaggaaugacuagauuuuucugcucgcaugacuucaaaauauaacacauau

SEQ ID NO: 9687 - RNA, 62 nt, Human
ggcaccuaccaccagggccagcuaauuuuuguauguuuaguagaaacgggguuucaccaugu

SEQ ID NO: 9688 - RNA, 62 nt, Human
uucuuauuuuauuuccuccuuaacaguauuuuuggcauuagacauucuuauugugaagaaau

SEQ ID NO: 9689 - RNA, 61 nt, Human
caagggaugccaguaagucugcaggugcggggugccaccuacaggcccaggccuguguccc

SEQ ID NO: 9690 - RNA, 62 nt, Human
aauggcauuugcugauuucauaaaccuuucacgucuggacgaauuaccaaaugccaugaauu

SEQ ID NO: 9691 - RNA, 52 nt, Human
guguggccacuccucagcauccuccccacccaccaugguucauuccgacuuu

SEQ ID NO: 9692 - RNA, 62 nt, Human
aagugaaaacacgagugugaaccucucuccccugcgucgccaccucuguaauugauguacau

SEQ ID NO: 9693 - RNA, 62 nt, Human
cggccugcugguccucugcuugcuggaacauucuaacauuuacacuuuuguuauaagcuauu

SEQ ID NO: 9694 - RNA, 62 nt, Human
caagaaacaaaaagcuucgcguccuuguuuugaccgucgacagaaguccaauuuucuugccu

SEQ ID NO: 9695 - RNA, 62 nt, Human
ugcccgagccucaacucagggucagcagccuccacggagccagccccaccugcccgaaaacc

SEQ ID NO: 9696 - RNA, 62 nt, Human
ucugacucucaucccuauuuuaccuauuuccauuuucgucuaucccaucuaugaggugauga

SEQ ID NO: 9697 - RNA, 62 nt, Human
ggcgccgggucgggccgagugcagcaccagguucuugacacagccugugaugccugaggaga

SEQ ID NO: 9698 - RNA, 62 nt, Human
ugcuggaaggauggggaucuuucaccuuuagggaucucagcacaauuagaaucguaaaguga

SEQ ID NO: 9699 - RNA, 62 nt, Human
aaggagcuucaaugauuuguaacugaaauaucagguucuagaagaaacuggcgcuuaaacca

SEQ ID NO: 9700 - RNA, 62 nt, Human
uugguguuuauaacucaugacccaaauccuuccaagacacaaaugaagcuaaucuucuuccc

SEQ ID NO: 9701 - RNA, 59 nt, Human
agccgaguccugccugaguguugcaagcucaggccuuuaaggacugcugaugcccccuc

SEQ ID NO: 9702 - RNA, 62 nt, Human
augucacguuuccauaucuccugcuggaaaucagaaaauauaauaaaauugcacaaaaaaaa

SEQ ID NO: 9703 - RNA, 62 nt, Human
ugacugguaaaaugaauccucagucggccuucuuucaaggcaaauugaaaaucacuggcaac

SEQ ID NO: 9704 - RNA, 62 nt, Human
uguggagaagccccugggggcucccugauuaauggaggcuuagcuuucuggauggcaucuag

SEQ ID NO: 9705 - RNA, 62 nt, Human
cgugacaguuugaaaccuucacaguuauccucuggggguaaaucaauucuucaacccuuggg

SEQ ID NO: 9706 - RNA, 62 nt, Human
aauucaguauguucuagcuacuucacacauguguacgcgacaguuauuuuuacaguaaggua

SEQ ID NO: 9707 - RNA, 60 nt, Human
gaggguggguggguccuuguguggccuggcgcgcaccacagggcagcacgggagacguug

SEQ ID NO: 9708 - RNA, 62 nt, Human
aggaacguuugcuccagcuucucucccuuuccagcaagggcagagcuccuaaagccaggggu

SEQ ID NO: 9709 - RNA, 62 nt, Human
ccccgagcucggggaagggguuuucccuuccucucugacccagaucugcgcgcggccuagcc

SEQ ID NO: 9710 - RNA, 62 nt, Human
cccucuauuuauaacuguccccuccaggcugacagugguucaacccugaauccuaaaacuug

SEQ ID NO: 9711 - RNA, 62 nt, Human
ugguaagcuaaaauaaguuuuuguuuguuuauuuguuuuugagauggagucucuacuaaaaa

SEQ ID NO: 9712 - RNA, 62 nt, Human; identical to SEQ ID NO: 9710

SEQ ID NO: 9713 - RNA, 62 nt, Human
uguuaacacucaugaagcauaccccggccucucaguucuugagggccuccccaccgcagcag

SEQ ID NO: 9714 - RNA, 62 nt, Human
gacuagacagaaguggggcggccugaacccugcuuccagccauggccaggggccacggaacc

SEQ ID NO: 9715 - RNA, 62 nt, Human
guggccacgcccagcacccuauugauggcuauaggacagguagcccucauuuccaugccuga

SEQ ID NO: 9716 - RNA, 62 nt, Human
agaucugcggucuccagacaucauaggccaugugacccacuaggggccgcuuaccccuggcc

SEQ ID NO: 9717 - RNA, 61 nt, Human
ugcagagaggaaggaagggagcuuuagcacaaguagcuacauaguguucaaggaucagcuu

SEQ ID NO: 9718 - RNA, 62 nt, Human; identical to SEQ ID NO: 9432

SEQ ID NO: 9719 - RNA, 62 nt, Human
ugaaaucauccauuuggggacaaauccacauuggggucuagaaacauccacguaucucauca

SEQ ID NO: 9720 - RNA, 62 nt, Human
ccauacguguaagcuuuuucuugaguguuaagucuuuuaccaaaagugucuguacagcagcc

SEQ ID NO: 9721 - RNA, 62 nt, Human
ggaacacaaaacauuuaaauaaaacuuuccaaauauuuccgaggacagagcugagucuuugu

SEQ ID NO: 9722 - RNA, 62 nt, Human
gugccaccuacaggcccaggccugugucccaagcaguacccaggcuuugcagaccacgcggg

SEQ ID NO: 9723 - RNA, 62 nt, Human
ccacuggcucuucacaguggaccccagcaccucgggguggcagagggacggcccccacggcc

SEQ ID NO: 9724 - RNA, 62 nt, Human
uuuuauaucauauucacauauuuguuuuuuuaauugguguuagaugacaugauuaauaaaaa

SEQ ID NO: 9725 - RNA, 62 nt, Human
guacaucccguucacacaugggaagagaagguacagaggcaaggaggaugccggcaaggccu

SEQ ID NO: 9726 - RNA, 62 nt, Human
auaauuaugcaagcaacaauucuguagccucaaguaagaccaccugugaacuugaucauuau

SEQ ID NO: 9727 - RNA, 62 nt, Human; identical to SEQ ID NO: 9607

SEQ ID NO: 9728 - RNA, 62 nt, Human
uaagggaggagacaucuggccuuuuuagaaccugagaggaaaaaaagagucuuuuuuucccc

SEQ ID NO: 9729 - RNA, 61 nt, Human
ucuggaucccaggauuaaaacuaaccgugaccacuacuccaaacaaaacacaauaugccua

SEQ ID NO: 9730 - RNA, 62 nt, Human
uaaacaacaacaaaaagaacucucucugugaggauugauccacuuuuaaauuucucuucuac

SEQ ID NO: 9731 - RNA, 62 nt, Human
gagcugguuaggaaccacagacugugacagagaagguggcgaccagcccagaagaggcccac

SEQ ID NO: 9732 - RNA, 62 nt, Human
aacacugaaugaauuuugaagcuuaauguuuuuaaaggcauaguuuuaucuuugacaucuaa

SEQ ID NO: 9733 - RNA, 61 nt, Human
agcaagcaagcguggcaccaucuuggaucugagccggucgagccccuguccccacccuucc

SEQ ID NO: 9734 - RNA, 62 nt, Human
gguuuucucaagaccuuccucaagcauuuuaucuuuagaagagaaacugaugggcaccugau

SEQ ID NO: 9735 - RNA, 62 nt, Human
aagccacaggugcauuuuacucaagucuucucuagucaaugaggggcacccagugcuucuag

SEQ ID NO: 9736 - RNA, 62 nt, Human; identical to SEQ ID NO: 9512

SEQ ID NO: 9737 - RNA, 62 nt, Human
gugaggguggcaugcccaccuccaguccagcccagggcgguagcagcaaagcguggcaucgc

SEQ ID NO: 9738 - RNA, 62 nt, Human
augggcuugauuccaccuggugggguggguggacccuggagacucucaggugaugggccagc

SEQ ID NO: 9739 - RNA, 59 nt, Human
agugacgcccccgugcagcuugggccggagggcaagggaugccaguaagucugcaggug

SEQ ID NO: 9740 - RNA, 62 nt, Human
gaggcagagagacgaggauacccagcgaaagggacgggaggaagcauccgaaaccuaggauu

SEQ ID NO: 9741 - RNA, 62 nt, Human
ugcauacgcgggugccccuucgccucccuccccuccgccagagcugccuguggccagacaca

SEQ ID NO: 9742 - RNA, 62 nt, Human
gggggugggcacuugggggcauccuggucacugcuggcccuagcauuggacccuaggagacc

SEQ ID NO: 9743 - RNA, 54 nt, Human
auugucugccauaagaaaaccacccacaagcucaacugugacccaagcagaauc

SEQ ID NO: 9744 - RNA, 62 nt, Human
aagagagagaucacucaaaugauuuuuauaaugaaaugacaagaauaacccuuuugguaacc

SEQ ID NO: 9745 - RNA, 60 nt, Human
ugccccgucacucccuucaaaggcgacagacccaagcccacgucaggagaggagcguggg

SEQ ID NO: 9746 - RNA, 62 nt, Human
aacuagucuuaccaaacuuagggggaaaccugugcuccauuaccacaugggugcaagucagc

SEQ ID NO: 9747 - RNA, 62 nt, Human
caugccgaagaccgugguguucccccuaaugacauaaacgcagccuuucuugcugucugaga

SEQ ID NO: 9748 - RNA, 62 nt, Human
guuuucccggcguuuuaggaucuguacauagagaaauauuuaaauuuuuagaagcaaaacuu

SEQ ID NO: 9749 - RNA, 60 nt, Human
auucauaaaugggaauagaacgugaaagccagcucuuucagaauauccucuauuaauacu

SEQ ID NO: 9750 - RNA, 62 nt, Human
ugucuaggaccaccugcccuaaccaggaauaaaggcaagacagccuggagaccaguuuguuu

SEQ ID NO: 9751 - RNA, 62 nt, Human
uucuggaagguuuaaauucauuaacguuaauaguuaauuauaacuuuuuuuuuaacuuaaga

SEQ ID NO: 9752 - RNA, 62 nt, Human
ggccuguggcuuggauccgccaugcagagauguggccgggcacccaucuuccuucccuccuc

SEQ ID NO: 9753 - RNA, 62 nt, Human
agaggauuagcaggagguagggacugcagguagggccuguuauguccaucauugcaugcguc

SEQ ID NO: 9754 - RNA, 62 nt, Human
aggggucuuagguguccccuccuagcccugugguuaucccuagguggcucucgaggaguuaa

SEQ ID NO: 9755 - RNA, 62 nt, Human
gauaggacuguauauaauuguaauaaauaccaguugccacuauuuaauuucugccuguggcu

SEQ ID NO: 9756 - RNA, 62 nt, Human
ugugauaucacuuuaauuuuucuuggguggcuuagagacuaagggaggagacaucuggccuu

SEQ ID NO: 9757 - RNA, 62 nt, Human
uuaauguagaugaccuaaagaaugcguuauccauccuauauaaaagaaagauaaaacacagg

SEQ ID NO: 9758 - RNA, 62 nt, Human
augaaaagaacaauuuugcaaauugcauucugaugcuugugaugaacacaaauguacuugug

SEQ ID NO: 9759 - RNA, 62 nt, Human
ccagcuaaacucugaaaagaaagaacaucuuucuuuacaagaucuuucugaucaugcuuccu

SEQ ID NO: 9760 - RNA, 62 nt, Human
gcagugaggcgagauugugccacugcacuccagcuugggcgacagagugagacuccgucuca

SEQ ID NO: 9761 - RNA, 62 nt, Human
cugugaggauugauccacuuuuaaauuucucuucuaccagcaacuugggaaaaauuaaauau

SEQ ID NO: 9762 - RNA, 62 nt, Human
ggaccuucgggcugugcccggggaaaggcaagguccggcccauccccaggcaccucacaggc

SEQ ID NO: 9763 - RNA, 61 nt, Human
aggcccugagaugugaggucugcugcuucacuggggcccgaugacuuuggcugggggaggg

SEQ ID NO: 9764 - RNA, 62 nt, Human
gagugcggaugggccccggacccgguguccugucuacaucuacagcuguucacuggaagcgc

SEQ ID NO: 9765 - RNA, 62 nt, Human
ugcaaagcgcuggggaugugccugucucugugugacccacgaacgggaagggagagcacugg

SEQ ID NO: 9766 - RNA, 62 nt, Human
uugagccauuguuaacaaugccuuuuuucuucacauaaaguaguugauuacgagggagucaa

SEQ ID NO: 9767 - RNA, 62 nt, Human
cgcugugggagaagaaugaaauaagacgugaaguguaggaaaucaugaaaagaacaauuuug

SEQ ID NO: 9768 - RNA, 62 nt, Human
acugaaaauaggcauauagauauauuccaagccgccugacgaucuaauuguaaaaaguaaag

SEQ ID NO: 9769 - RNA, 62 nt, Human
caugccuguaaucccagcauuuugggaggcucaggcagacaaaucgcucuagcucagaaguu

SEQ ID NO: 9770 - RNA, 62 nt, Human
aaaagacgacuaauuuccaaacccguuuguucucagauaaaaagcaguuuuauaaacccgca

SEQ ID NO: 9771 - RNA, 57 nt, Human
ggccacacaaaucuccaggagccaccacucaacacaauggcccugccucccaccgcu

SEQ ID NO: 9772 - RNA, 62 nt, Human
acugugagggugggugcuggcugagcccccggggcagcaggagccaggcaggugaugucuuu

SEQ ID NO: 9773 - RNA, 61 nt, Human
ugaaaccacgcugcgcuuccgaugcccccgcuugccguguaaugguucagcuaaucccaug

SEQ ID NO: 9774 - RNA, 62 nt, Human
ucaugccuguaaucccagcauuuugggaggcucaggcagacaaaucgcucuagcucagaagu

SEQ ID NO: 9775 - RNA, 62 nt, Human
gucucuccaagcagcugcagaccccagcucgaauuuugcacauggcggggucccgggaaggg

SEQ ID NO: 9776 - RNA, 62 nt, Human; identical to SEQ ID NO: 9774

SEQ ID NO: 9777 - RNA, 62 nt, Human; identical to SEQ ID NO: 9775

SEQ ID NO: 9778 - RNA, 62 nt, Human
aggaaucuggaaauauuuauauccacggaguccuuggauccagugcuacgucaguaaauagc

SEQ ID NO: 9779 - RNA, 52 nt, Human
gccgggagucccgcguucccgucccucgaugauccaguuccaggagaaguga

SEQ ID NO: 9780 - RNA, 62 nt, Human
gacgagggugagguggccacagugaccggacgacaaaugagacucugcaaaugagacuccag

SEQ ID NO: 9781 - RNA, 62 nt, Human
aaaaaaaaaaaauuuaguaaaaaucaaugguaagcuaaaauaaguuuuuguuuguuuauuug

SEQ ID NO: 9782 - RNA, 62 nt, Human
uauuuuuuaaaaaucaaaaaaugacuugcaaauuguuuuuuaaaaguaauuuugcauugcuu

SEQ ID NO: 9783 - RNA, 62 nt, Human
gaggaccugucacaguguccggcccugccuccauccaggauacacaggcuccaccucagagu

SEQ ID NO: 9784 - RNA, 61 nt, Human
aauuagauguacagugaagggaaaagaaaaaaaaugggcgaagagaggguggaaaauaaaa

SEQ ID NO: 9785 - RNA, 62 nt, Human
cugcugaauuguuuauaauggcaagaaauaggaaaccccccaaugucuguugaacagcuauc

SEQ ID NO: 9786 - RNA, 62 nt, Human
cccagcacuuugggagaccgaggcagguggaucacgaggucaggagauagagaccauccugg

SEQ ID NO: 9787 - RNA, 62 nt, Human
cgcucagaggagccuccaguuacuuuccucacaucucccaaacucucucuuaauugcgauaa

SEQ ID NO: 9788 - RNA, 62 nt, Human
auuauauuaacaucacaauugucaucuauauauucuauaugaaaaauauuuauuauaacuua

SEQ ID NO: 9789 - RNA, 62 nt, Human
guuggaccccucucacugacuagcugucugguaggggugcuaggaccagccucgccuguggg

SEQ ID NO: 9790 - RNA, 62 nt, Human
gacgucaaaaacucaccauggaccccaaggcagaaaccaagaacugucugcaggcaaauaag

SEQ ID NO: 9791 - RNA, 62 nt, Human
cugccaagggcaucacuggcugacucucugugcacgacucaauguuugugucuggcccacag

SEQ ID NO: 9792 - RNA, 62 nt, Human
gagggugguccgcagacaccccgggaugucagcaucccccgaccugccuucuggcggcaccu

SEQ ID NO: 9793 - RNA, 62 nt, Human
ugugcuaagugcuggaauacauuaucucauugaauuaucacaacgaccuuuucaaguaggca

SEQ ID NO: 9794 - RNA, 59 nt, Human
gaaauaucagcugagagauuauuugcugcuguuauucaaaaggccauuuaugaaguuag

SEQ ID NO: 9795 - RNA, 62 nt, Human
agcugguuacucaggguucaucuguccauggccuuucuaauaaacuguugaguugaagcacg

SEQ ID NO: 9796 - RNA, 60 nt, Human
gcacuccagcccgggcgacagagcgagacuccaucuaccagauccuuaugacgcagcuga

SEQ ID NO: 9797 - RNA, 62 nt, Human
uuucagaauauccucuauuaauacugaauuuagauaucuuuauuccauuuauuaugguacaa

SEQ ID NO: 9798 - RNA, 60 nt, Human
aagcacuuugacauuugcaccuuaggagaggcagauguuaaaauggaauccaaagaccac

SEQ ID NO: 9799 - RNA, 62 nt, Human
gcugcagacggggaguagcuuuguggaaacugauuugauggacacugcaccagcuuccuuca

SEQ ID NO: 9800 - RNA, 62 nt, Human
gcgcccaacccggcagacgggugcaggcccggccuuuccccacgcggacuccgcgcgacccc

SEQ ID NO: 9801 - RNA, 62 nt, Human
aggcuccauccuuucuccuuucugccagccgauguguccucaucucaggcccgugccuggga

SEQ ID NO: 9802 - RNA, 61 nt, Human
agaaacuguacauagccggugaccgaaugcgaccuuugccagccagagcugcugccagagc

SEQ ID NO: 9803 - RNA, 62 nt, Human
cgcaauguucugaaggcuccagggccacuuuguuuguaaguaugaucugggccucaaaauac

SEQ ID NO: 9804 - RNA, 54 nt, Human
uaggaaauaagucagaauccccaauucgauagaaacuuacaggucuugugaucu

SEQ ID NO: 9805 - RNA, 62 nt, Human
guugcuuguauuaacacgaaacuagagagaaauaguuucugaagccaguuuauugugaagau

SEQ ID NO: 9806 - RNA, 62 nt, Human
ugggagaggggaaggguucaagcccgggaugggcccgcgugacgucgauggguccugcggcc

SEQ ID NO: 9807 - RNA, 62 nt, Human
gucacaugaucacaguucagcgggaggcuuuccguacccacacuggcuguagccacuucagu

SEQ ID NO: 9808 - RNA, 59 nt, Human
aaaccagccugaccuuuccuuuagcauuagauguaauaaaauaacuuuggaaauuuguc

SEQ ID NO: 9809 - RNA, 62 nt, Human
agaagcuggcuggggacucuagccucuguguucauaaagacauuaagaaguggauggauguu

SEQ ID NO: 9810 - RNA, 57 nt, Human
cagagcccuucccuccaggaacugauccuugggaaaacagccaugggccaggcugca

SEQ ID NO: 9811 - RNA, 62 nt, Human
cagggccuuccugaccaacagccagcucuguccuuccccccaggaaacacauguucauuugu

SEQ ID NO: 9812 - RNA, 59 nt, Human
gggcucagcccccuccaggaugcagcccccucccccgcaccccggaaccggcgucgcug

SEQ ID NO: 9813 - RNA, 62 nt, Human
ccugccuuucguagaguuuugugugacuuuuuaaauuauucaugugucccuuaaaaguuuca

SEQ ID NO: 9814 - RNA, 54 nt, Human
aaucuaugugaugucuuccaacguuaauaaaucacacagccucccaggagggag

SEQ ID NO: 9815 - RNA, 62 nt, Human
ucuaaauuuguaagcauucauaaaacaggaaaaaguaaacuaucauucggaagcacagccca

SEQ ID NO: 9816 - RNA, 62 nt, Human; identical to SEQ ID NO: 9391

SEQ ID NO: 9817 - RNA, 62 nt, Human
uuucuuguaugcaugagacucaacaucaggauccacagcuuaaagaugggaauucagguaug

SEQ ID NO: 9818 - RNA, 62 nt, Human
cgacuggccaagaccuccacguccccagaguccagcccuggaaauuccaagggcccuggcgu

SEQ ID NO: 9819 - RNA, 62 nt, Human
agaugucaguaucagcuggcugggcaguggaauuuugagcgaccuuuacuuuauacuuuucu

SEQ ID NO: 9820 - RNA, 59 nt, Human
uuuugaaagauuuuggcacuauauuuaauuggaagguaaaauauuguacaugugaucca

SEQ ID NO: 9821 - RNA, 62 nt, Human
acuccuggggcacucgccugcccccagcggaguucaguccgagauggaagcccgagcccugg

SEQ ID NO: 9822 - RNA, 62 nt, Human
ucauccaaagguguuacccugguuucauugaaccuaaccccauucuuuguaucuucaguguu

SEQ ID NO: 9823 - RNA, 62 nt, Human
aauggaacccuaacuauucucccaucaaaucauauauguugaccugucugaauuauaaacca

SEQ ID NO: 9824 - RNA, 56 nt, Human
ggaggggagaagccacacaacaaucuggacccaauaaaguggagagaagggcgucu

SEQ ID NO: 9825 - RNA, 62 nt, Human
ggguuucccuccugacuagccucucuuacaggaauugugaaauauuaaaugcaaauuuacaa

SEQ ID NO: 9826 - RNA, 55 nt, Human
ucaggcacaagggauugccucugucauuagcgucaaacagagucuagcaguuaug

SEQ ID NO: 9827 - RNA, 62 nt, Human
uuggccauucuaaaguuggugcucugacacuuguuuagacgaugcuugguuuauuucaauca

SEQ ID NO: 9828 - RNA, 60 nt, Human
ccuauuaccaagcgaguguuuguaaccauguaguuuuggaacccacugcaaaauuuucua

SEQ ID NO: 9829 - RNA, 62 nt, Human
ucccagcaccuggcacacaguaagugccugguaaauaaacaauggcuauauuugcuugucau

SEQ ID NO: 9830 - RNA, 62 nt, Human
ccuccgccagagcugccuguggccagacacacgguggagggaagugcacgcgaaacagacac

SEQ ID NO: 9831 - RNA, 62 nt, Human
uguuggccggagggacugcuggcccggccucccuuccguccaggcagccgugcugcagacag

SEQ ID NO: 9832 - RNA, 54 nt, Human
ggucccuucuaggacacagaggccaggcgucccaaccccacagucugggggcca

SEQ ID NO: 9833 - RNA, 62 nt, Human
uagaugaauguguuaagugaaaugauacuuguacucccccuaccccuuugucaacugcugug

SEQ ID NO: 9834 - RNA, 59 nt, Human
uuucucuacuguaaagugauuuuguuugcagguaagaaaauaauagaugacucaccaca

SEQ ID NO: 9835 - RNA, 62 nt, Human
ccucucccggcaacaucucugggaaucaacagcauauugacacguuggagccgagccugaac

SEQ ID NO: 9836 - RNA, 61 nt, Human
ugaggcucuaguuguugcuguuguggcgggaaaguuaagaaacauagcccuuaaggaaacc

SEQ ID NO: 9837 - RNA, 62 nt, Human
auacgaacaaaacacacgcgcgcacacacacacauacacgaaagagagagaaacaaacuuuu

SEQ ID NO: 9838 - RNA, 62 nt, Human
agaauuuuuggucaaaagucaaaauaguauuagaauauugaaauuauugauagcuuucauaa

SEQ ID NO: 9839 - RNA, 62 nt, Human; identical to SEQ ID NO: 9837

SEQ ID NO: 9840 - RNA, 62 nt, Human; identical to SEQ ID NO: 9838

SEQ ID NO: 9841 - RNA, 62 nt, Human; identical to SEQ ID NO: 9807

SEQ ID NO: 9842 - RNA, 57 nt, Human
gcaagaaaaagugcaugggagggguuuuagugguuuaaugaauuuuuaauuaagaaa

SEQ ID NO: 9843 - RNA, 62 nt, Human
ucauuuuguaauauuugaauuuuuacauuuguuguacaaucaggaaaagcaauaaagauuuu

SEQ ID NO: 9844 - RNA, 53 nt, Human
caccaucaggagaugaauauggaacaucuccuauguaccaggcacugugcuaa

SEQ ID NO: 9845 - RNA, 62 nt, Human
aaauguuuauggaagaagcacuucauugaaaguagugcuguaaauauucugccauaggaaua

SEQ ID NO: 9846 - RNA, 61 nt, Human
caacuaagaaaccacuauuauauauuuuuucccuucagucacauagacuucagacaacucu

SEQ ID NO: 9847 - RNA, 62 nt, Human
uccacauaacugaucacccauggcugccucuccuauuaucuauuaucacugaaacuuaguag

SEQ ID NO: 9848 - RNA, 62 nt, Human
gagggcaaaacacaaaucccuuugcuaaaaagaaccauauuauuuugauucucaaaggauag

SEQ ID NO: 9849 - RNA, 62 nt, Human
caagucuaaaauacaccuggaucugucuagucaaucaacauagcagagacagucuuaaaccu

SEQ ID NO: 9850 - RNA, 60 nt, Human
uuacagauuuacguaugggcugaugaagaggccuucuuaaguuccagagugcuauaaucu

SEQ ID NO: 9851 - RNA, 62 nt, Human
gacagcagaugucauccaggaacagccacacacgguucuccaggccgccgucagcagcucaa

SEQ ID NO: 9852 - RNA, 61 nt, Human
ccuaccugcugcaucgucaggcucccacgcuuuguccgugaugccccccuacccccucacu

SEQ ID NO: 9853 - RNA, 62 nt, Human
gcgaucucggcucagccucccgaguagcugggauuacaggcaugugccaccacgcccggcua

SEQ ID NO: 9854 - RNA, 61 nt, Human
cguuucuguguagaaacuggaagcuguucagggcaucggcagcugaacccugcuccguugg

SEQ ID NO: 9855 - RNA, 62 nt, Human
guuuuuaccgauuuauagagcagucaaauccgaagugcucgagugcuuagaaacccccucug

SEQ ID NO: 9856 - RNA, 62 nt, Human
ggccuguggggcacuggggaugguaaccucacugccccgucacucccuucaaaggcgacaga

SEQ ID NO: 9857 - RNA, 62 nt, Human
ucccucuugcugucuaauagaagcuuacuuuuugcuauaucagcauuuguuacagccaauau

SEQ ID NO: 9858 - RNA, 61 nt, Human
caccaucaccaccaccaccaucaucaucauugucaucgucaucauuauguugcuuuuagcu

SEQ ID NO: 9859 - RNA, 62 nt, Human
uauugcucucuagccuggaaaacagagugagacccuaucucaaaaaaaaaaaaaaaaaaaaa

SEQ ID NO: 9860 - RNA, 62 nt, Human
aagauuuggcucuaccuuggaucugcuaguaaauaacuaauaggcaggcaguuauuugggua

SEQ ID NO: 9861 - RNA, 62 nt, Human
ucauuugguuuuucuccucucuuauuuuuuuggguagagacagggucccuuuguugcccagg

SEQ ID NO: 9862 - RNA, 60 nt, Human
cugacuauacuuaguuugaaauggugcaggcuuagucuuaagccuccaaaggccuggauu

SEQ ID NO: 9863 - RNA, 62 nt, Human
gacuccugcucucuggaggacggucaguccaugucucggagaaacgggugagcugagcuugg

SEQ ID NO: 9864 - RNA, 60 nt, Human
guagggggugggagagggaacuggcccucgcuuuaccggauggucuaucugccccuaccu

SEQ ID NO: 9865 - RNA, 62 nt, Human; identical to SEQ ID NO: 9811

SEQ ID NO: 9866 - RNA, 61 nt, Human
gacuucaaaggaaaggaacaaauuuucaaagacuugggggagugaaggcagagccuggugc

SEQ ID NO: 9867 - RNA, 62 nt, Human
agagcugacccccugcugccaucuccaggccccuuaccugcagggaucauagcugacucaga

SEQ ID NO: 9868 - RNA, 62 nt, Human
uuuggguuuuugagauuugcuggugaagucagugacgaaaaauaaaccuucccuuaucuucc

SEQ ID NO: 9869 - RNA, 62 nt, Human
uaaguuaacuugucaacggcaugguuuaaucccuucuuuacacuuguguaaauuucaguuac

SEQ ID NO: 9870 - RNA, 62 nt, Human
auauuguuucaauuuagucuauccuggauauguacuaacgaauauuaccaccagagaagaga

SEQ ID NO: 9871 - RNA, 62 nt, Human
uuuguucuggaauauggauaucucagccuggaugccgaggaagcugcuggaugcuuaauggu

SEQ ID NO: 9872 - RNA, 62 nt, Human
uggcuuccugucugcuggccucuccugcuacuuaucacuucaccacgaacucucugccugag

SEQ ID NO: 9873 - RNA, 62 nt, Human
ugggugcaagucagcauuguaaguuuucucagguuauuauuauuagagagguuggaaacauu

SEQ ID NO: 9874 - RNA, 60 nt, Human
agguacaauagaugacuuuauuuguuuaaaauguuuaauauauauacauacauauauaua

SEQ ID NO: 9875 - RNA, 62 nt, Human
ccuggccaauauggugaaaccccaucucuacuaagaauacaaaaaauuagcugagcauggug

SEQ ID NO: 9876 - RNA, 61 nt, Human
uaauuuuacuccuuccucuuauuuuuuuaaaagauuaucgaacaauaaaaucauuugccuu

SEQ ID NO: 9877 - RNA, 62 nt, Human
aaacugcuguuuucuaggccaaaaauggugagcgaucauuuauuucaugauucaaccugaua

SEQ ID NO: 9878 - RNA, 53 nt, Human
uuguauauauuaaaacagagauaugugcaugaaaucaagaaaaaagaaaugaa

SEQ ID NO: 9879 - RNA, 62 nt, Human; identical to SEQ ID NO: 9607

SEQ ID NO: 9880 - RNA, 62 nt, Human; identical to SEQ ID NO: 9607

SEQ ID NO: 9881 - RNA, 62 nt, Human
uuuuuuuuuuguuuugauuuuuuuuaaacuaaagcuauauaaagcuuguggauuaaacagaa

SEQ ID NO: 9882 - RNA, 62 nt, Human
caagacgacagcucuguaucugccaugugaagagaauuaacaauaaaagugugaagagcgau

SEQ ID NO: 9883 - RNA, 62 nt, Human
gguccuugcagcuguggcagcagcaggcuccccagcggcccagggugggccagaccagcagc

SEQ ID NO: 9884 - RNA, 58 nt, Human
cucucagauccacgcccccaggaguucugacgacacgaaguagcaggacagggauuca

SEQ ID NO: 9885 - RNA, 62 nt, Human
agaggggaauccgaggccaucaaccuuggugacagcagcgcagugccaaugcugaucacacu

SEQ ID NO: 9886 - RNA, 55 nt, Human
agccccaacacaugacgccaucugaagacccgcaacggaguggggguggcggccg

SEQ ID NO: 9887 - RNA, 56 nt, Human; identical to SEQ ID NO: 9582

SEQ ID NO: 9888 - RNA, 62 nt, Human; identical to SEQ ID NO: 9583

SEQ ID NO: 9889 - RNA, 62 nt, Human
uucuaggucuuugcucugcaggaucgggaucagagcgugggaggagguggggguggacgucc

SEQ ID NO: 9890 - RNA, 62 nt, Human
uuaaugcugacuuaauuggcuuaaggaauuuuuauaggcguaagauaaauuuucacagacua

SEQ ID NO: 9891 - RNA, 62 nt, Human
cuguucugagggcccagggcccgggcacccacaagcccgugacagaugccaacuucccacac

SEQ ID NO: 9892 - RNA, 60 nt, Human
cuggaguuaaauuuuccaacagccauguugaggaauagcacucugcauguuuuuguuuug

SEQ ID NO: 9893 - RNA, 62 nt, Human
acaauagcacucccucccaacuauucuuuaaugcuguaccuagcuuuauuuuucuucagaau

SEQ ID NO: 9894 - RNA, 61 nt, Human
cugaggcagggcagagggaccuuugauaggcuacgauacuauuuuccugugcaucacacuu

SEQ ID NO: 9895 - RNA, 62 nt, Human
cguacucaguaacaggccggaaaauugugcucuagaagaauaaaacugaaaaacucuagaga

SEQ ID NO: 9896 - RNA, 58 nt, Human
caugucugauuugccaccuggaugaaggcagacaucaacaugggucagcacguucagu

SEQ ID NO: 9897 - RNA, 62 nt, Human
uagggggucuuuagagugaaaugaguugcacuaaaguacguaguugaggcuccuuuuuucuu

SEQ ID NO: 9898 - RNA, 62 nt, Human
ccccgccucuccugccuuguuugccccucagcgugccaggcagacugggggcaggacagccg

SEQ ID NO: 9899 - RNA, 62 nt, Human
gugaaacugggauaaaaacggggcuuggccgaaggacuuuuaucugucuuggucaccccggc

SEQ ID NO: 9900 - RNA, 55 nt, Human
uaggaucuguacauagagaaauauuuaaauuuuuagaagcaaaacuuauacaaca

SEQ ID NO: 9901 - RNA, 62 nt, Human
gggaggagacucgcugggagugggagggcagcacgggcgugaaggucggaggacagagaaag

SEQ ID NO: 9902 - RNA, 62 nt, Human; identical to SEQ ID NO: 9391

SEQ ID NO: 9903 - RNA, 62 nt, Human
ccuggcgccuggcggucaccuggugccuacuguccgacaggaugccuugauccucgugcgac

SEQ ID NO: 9904 - RNA, 62 nt, Human
gauggcaaccccccacccccucccucacacuaaaacggcguaucugggcaucguucccagug

SEQ ID NO: 9905 - RNA, 62 nt, Human
uugaguucuucuuuucauggcuuuuauucacugugacuaauaagcuuccuaauaaauccuug

SEQ ID NO: 9906 - RNA, 60 nt, Human
auaauggauauuuuuuaacuuggcgagaugugucucucaauccuguggcuuuggugagag

SEQ ID NO: 9907 - RNA, 62 nt, Human
augcccgucucugucccaggcgggauggggcacagugcaggacacagccauguacaccaaga

SEQ ID NO: 9908 - RNA, 62 nt, Human
uuggccauggggacgcccucagucuagggaucuggccacagacucccuccugugaaccaaca

SEQ ID NO: 9909 - RNA, 62 nt, Human; identical to SEQ ID NO: 9907

SEQ ID NO: 9910 - RNA, 62 nt, Human; identical to SEQ ID NO: 9908

SEQ ID NO: 9911 - RNA, 62 nt, Human
guaaucaaagcuuccuaccguuuggccuacuauuccagacuagucccucgagggguucccuu

SEQ ID NO: 9912 - RNA, 62 nt, Human; identical to SEQ ID NO: 9552

SEQ ID NO: 9913 - RNA, 62 nt, Human; identical to SEQ ID NO: 9911

SEQ ID NO: 9914 - RNA, 62 nt, Human; identical to SEQ ID NO: 9552

SEQ ID NO: 9915 - RNA, 62 nt, Human
ugugauguguuuggccuuaccaaagcaaaagagggugcaagaaugugggaguaugucugccg

SEQ ID NO: 9916 - RNA, 60 nt, Human
aaaaugcccaggaguccuggaagcuacgcggacuugcagagguuuuauuuuuuggccuua

SEQ ID NO: 9917 - RNA, 62 nt, Human
cuuuuuaacaugccccugugaacagguauuuucaggacucaaacuaccacaaugaacagagu

SEQ ID NO: 9918 - RNA, 61 nt, Human
acuuuuccagaugaacggacgaguggggagugggcggugaagcuuccaggagggggaagag

SEQ ID NO: 9919 - RNA, 62 nt, Human
acugacagagccacacacccagguacaccccccaggcuaauauggggacacacaaaaauaug

SEQ ID NO: 9920 - RNA, 57 nt, Human
ggcagacugggggcaggacagccggaagcugagaccaaggcuccucacagaagggcc

SEQ ID NO: 9921 - RNA, 62 nt, Human
ggaucaaagacccuccuuguauauccuuaaaccuguacucuauuaccaggccacugugccug

SEQ ID NO: 9922 - RNA, 53 nt, Human
aggugggaaaugguauuucuauuuuuaaauccagugaaauuaucuugagucua

SEQ ID NO: 9923 - RNA, 62 nt, Human
cuccagggaggccccagcaaccacaccaucuucuugcugugagaggucucaccccgggcuac

SEQ ID NO: 9924 - RNA, 49 nt, Human
ccuucagcaauguugugugaaauauacuaaacaucaaagaaucuauguu

SEQ ID NO: 9925 - RNA, 62 nt, Human
gcauccuaacagaggaaggauccaugauucugcuuugguccaauugcuuccucucugcagag

SEQ ID NO: 9926 - RNA, 62 nt, Human; identical to SEQ ID NO: 9731

SEQ ID NO: 9927 - RNA, 62 nt, Human
agcuuggaguugucugucacgcacauguguccugugguuauagcuagaaggacaggagucuc

SEQ ID NO: 9928 - RNA, 62 nt, Human
uucuuagcagaugcugccuuauuuggccacugaaacaaucaaagcuaauaaaugcuuaaaga

SEQ ID NO: 9929 - RNA, 62 nt, Human
gaccccgugucugcccaggugggcagccuugagcccaggggacucagugcccuccaugcccu

SEQ ID NO: 9930 - RNA, 62 nt, Human
ggcagccgugcugcagacagaccuagugccgagggauggacaggcgagguggcagcguggag

SEQ ID NO: 9931 - RNA, 62 nt, Human
gcuacaggcugggccccuggcgugcccugaccgugcagcagagugaggcuggggcagcagag

SEQ ID NO: 9932 - RNA, 60 nt, Human
aggcugggagccgcacagcccuccccuccugcgcuggaaacccucccugacccccacccu

SEQ ID NO: 9933 - RNA, 62 nt, Human
gaggccagaaaauguaucgggaaucccaggaggacggcccgacuggggcaaaagcuccagcg

SEQ ID NO: 9934 - RNA, 61 nt, Human
aaccgugugauaagguugugugucgugugggaguggggcgauuuuuuaugugccaaauacc

SEQ ID NO: 9935 - RNA, 62 nt, Human; identical to SEQ ID NO: 9562

SEQ ID NO: 9936 - RNA, 60 nt, Human
ugaaauaucagcugagagauuauuugcugcuguuauucaaaaggccauuuaugaaguuag

SEQ ID NO: 9937 - RNA, 62 nt, Human
aguuaauuuugaguaauuguauugucagaaaagugauuaguacuauuuuuuuuuguuguuuc

SEQ ID NO: 9938 - RNA, 62 nt, Human
uaggggaagguuggggggacccagcaaggacucagagagucagacagugccacuuggccacu

SEQ ID NO: 9939 - RNA, 62 nt, Human
gcaguucaucucauuucaaauguuuauggaagaagcacuucauugaaaguagugcuguaaau

SEQ ID NO: 9940 - RNA, 56 nt, Human
uuauucuaucuccugaagauuuaauugcuauuguuacccauucgaaaucagcugua

SEQ ID NO: 9941 - RNA, 62 nt, Human
aaacaugccaauccugagaauaaccuccccuccagccagagauauuccaacucugcaauaaa

SEQ ID NO: 9942 - RNA, 62 nt, Human
aucccaaagcuuugggaagcggcacaggggcucccgccgguauagaaagcagaaggagccca

SEQ ID NO: 9943 - RNA, 62 nt, Human
gcagucaggguacuaagcaugggugggaacuccugccuuauaaaaauuguuuuuguguucuu

SEQ ID NO: 9944 - RNA, 62 nt, Human
caauggaaacuuacagaugccugccugggaugaugaggcacauucagaacaaaugcuuuuuu

SEQ ID NO: 9945 - RNA, 62 nt, Human
gcuucuuggccaccuuucccuggggacccuaacaggcccagagcagagccccuuaccuccca

SEQ ID NO: 9946 - RNA, 62 nt, Human; identical to SEQ ID NO: 9430

SEQ ID NO: 9947 - RNA, 62 nt, Human
aggcgggauggggcacagugcaggacacagccauguacaccaagaagagaguaccaaguagu

SEQ ID NO: 9948 - RNA, 60 nt, Human
gucccccagauaccuauuauuuuacacaauuugaccuauaggaggacacugaguaauuua

SEQ ID NO: 9949 - RNA, 62 nt, Human
gaagcuggcccaggucagguccgcaaaggcuucugaagaagaggaagggcgaguaggggcac

SEQ ID NO: 9950 - RNA, 60 nt, Human
uauuuguauucuccauauuuuggaguaauuaucuacaugauguuuauaguuccugugguu

SEQ ID NO: 9951 - RNA, 62 nt, Human
cgcagcagccucggacccggauugcguuugccuuagcggauauguuuauacagaugaauaua

SEQ ID NO: 9952 - RNA, 59 nt, Human
aacgucuuaccgugccuauuaccaagcgaguguuuguaaccauguaguuuuggaaccca

SEQ ID NO: 9953 - RNA, 62 nt, Human
auccauuggauuuuuuuuuuuuuuuccuaaacaaaguuuuuacacugagcagaugcucuguc

SEQ ID NO: 9954 - RNA, 58 nt, Human
uagcuaauuucccauuuacaacacagaaaugauauagagcuaguucgcuccaacucuu

SEQ ID NO: 9955 - RNA, 62 nt, Human
gagccuaggggauccggggcuuguacagaagagacaguccaaggggacuggaucccagcagu

SEQ ID NO: 9956 - RNA, 56 nt, Human
cgagcaggccggggguguccgggaggucuuugggcaucgcggucugggguugggac

SEQ ID NO: 9957 - RNA, 62 nt, Human
aaaguaguuccagugauuuaaaauacgguuccaaauacgcuaaaaccaacuugugccaacca

SEQ ID NO: 9958 - RNA, 62 nt, Human
uuuuuguaauauacagcuuuuuuuuuaaggcaucauuuucgagggucuaaaauuaucuggua

SEQ ID NO: 9959 - RNA, 62 nt, Human
aacccucaccagauaaacuaaucuaaaaaacccucgacccgacgaagcgcugagauucuucc

SEQ ID NO: 9960 - RNA, 62 nt, Human
acugugaccaucacucaguccaaacaagugaguggcccucgaggccacaguuaugcaacuuu

SEQ ID NO: 9961 - RNA, 62 nt, Human
ucauacaggcuucauucaaccuggcguuccccuccauaauuaagaugaaacauuccgguuuu

SEQ ID NO: 9962 - RNA, 62 nt, Human
gcaggucuaaugacuaauaauuggaguacggcugcuagacaacugcauuuuaguauuucucu

SEQ ID NO: 9963 - RNA, 62 nt, Human
gccagccccuccccaggagcuccuccggggccaccgaccgcaugugggugugagccuggccg

SEQ ID NO: 9964 - RNA, 61 nt, Human
guuugguaguagguuuuuauuuuuaauuucuguacuaaugaaauuccugacuuuaauuucu

SEQ ID NO: 9965 - RNA, 62 nt, Human
cccugggugucaggcagguggcugcacccuaggccaggcgcagaggccuggcaggcaggcuu

SEQ ID NO: 9966 - RNA, 60 nt, Human
ugucuaggaaaguaauaguauaacuauagggauaccgaaacaggaaaaaccagccaucac

SEQ ID NO: 9967 - RNA, 62 nt, Human
caagucucacacuaaacaugcccgggcuucgaugugccuggaggauuuccccacagggaccc

SEQ ID NO: 9968 - RNA, 62 nt, Human
acuccgaaucgcuggcgacacauucuccuuuccagcuaggaaaggguuccucgcggcugguu

SEQ ID NO: 9969 - RNA, 62 nt, Human; identical to SEQ ID NO: 9933

SEQ ID NO: 9970 - RNA, 62 nt, Human
gagagccugcuccaggacaacuggcugucccggggcgggccaugggcccaggcccugccaga

SEQ ID NO: 9971 - RNA, 60 nt, Human
cugcggagcuggagccguagauuccgugccugccgccgcagcgccgccgacaacgcgggu

SEQ ID NO: 9972 - RNA, 56 nt, Human
gaaugaauuuugaagcuuaauguuuuuaaaggcauaguuuuaucuuugacaucuaa

SEQ ID NO: 9973 - RNA, 62 nt, Human; identical to SEQ ID NO: 9248

SEQ ID NO: 9974 - RNA, 62 nt, Human
uugacaccugauacccagacuuaauugguauuuguucuugcauuggccaaagugaaaauuuu

SEQ ID NO: 9975 - RNA, 62 nt, Human
uucccgaggcccagggccaaggcacucccaccgccuaccuuagcacagggucucugcaggac

SEQ ID NO: 9976 - RNA, 60 nt, Human
auaacuggggaaagaaguugugaucuguugccuaaacuaaagcuuaaaaguuuaguaaaa

SEQ ID NO: 9977 - RNA, 62 nt, Human
cgaggcggagcgccaguggacccuggccgcagacacgcucgacccucccgccucgcugggcg

SEQ ID NO: 9978 - RNA, 62 nt, Human
ugccaccuaaacgaucaguguggugcugcguucuggccaguaaauuccauguuuuuggcuau

SEQ ID NO: 9979 - RNA, 62 nt, Human
ccugggggucccagggugguggggguggcaggugguaccacagcucugagagcagauaccag

SEQ ID NO: 9980 - RNA, 62 nt, Human
gaccuagugccgagggauggacaggcgagguggcagcguggagggcucggcguggauggcag

SEQ ID NO: 9981 - RNA, 62 nt, Human
ggcuaauauggggacacacaaaaauauggccuucaacaccuacaagucuucucugugucccc

SEQ ID NO: 9982 - RNA, 62 nt, Human
uucgggggucguucugugccuuccagcaucuuguacagcaaauccugacucgugucuuuuua

SEQ ID NO: 9983 - RNA, 62 nt, Human; identical to SEQ ID NO: 9907

SEQ ID NO: 9984 - RNA, 62 nt, Human
cacaccacuggguuugccagaaacagggaaggagggcguuaagggaaaaaaaaaauccucaa

SEQ ID NO: 9985 - RNA, 62 nt, Human
auccaaacugugucuguuuccuuccagcacuaacaauguccauugcuggaucuagcgacauu

SEQ ID NO: 9986 - RNA, 60 nt, Human
auauccucuauuaauacugaauuuagauaucuuuauuccauuuauuaugguacaaauaac

SEQ ID NO: 9987 - RNA, 62 nt, Human
ccuccucccccagagggguggguuccucuuccccacuccccaccuucaauuccugggcccca

SEQ ID NO: 9988 - RNA, 62 nt, Human
aaggcccguggugacgagggugagguggccacagugaccggacgacaaaugagacucugcaa

SEQ ID NO: 9989 - RNA, 62 nt, Human
cuuuuuucuguuugcacuguuuguuuguaugauguuagcuaauuccacuguguauauaaauu

SEQ ID NO: 9990 - RNA, 62 nt, Human
uuuguuuuuguuuuaacuuucuuguggcaagcuauaccggaaaagcggcaugucaaaaauac

SEQ ID NO: 9991 - RNA, 62 nt, Human; identical to SEQ ID NO: 9408

SEQ ID NO: 9992 - RNA, 52 nt, Human
ugccucucucacacuuguaauucucgacacaaaauaagugaaacuucuuuuu

SEQ ID NO: 9993 - RNA, 62 nt, Human
cugggccucaaaauaccauaguagcugcuugauaaaauucuaaaaauaucugguucucuauu

SEQ ID NO: 9994 - RNA, 62 nt, Human
gcuuccccaugagcgucugcaaaacacuugccugaauacauaucacguauuuuagacucgaa

SEQ ID NO: 9995 - RNA, 62 nt, Human
aucggcagcugaacccugcuccguuggucagcguuacuaucaucucggaucauauggagcuc

SEQ ID NO: 9996 - RNA, 62 nt, Human
ggccgguggaaugacuugagcagcucugggaguggggaaaaaagacgacuaauuuccaaacc

SEQ ID NO: 9997 - RNA, 62 nt, Human
ugcgcuggggccaugggguggccccgccggggcagcgggggagcugccugcagaagagccag

SEQ ID NO: 9998 - RNA, 62 nt, Human
ucugugggguccuguugaaaagaacaaaauaaaggagcccaaggggucauucugucucagca

SEQ ID NO: 9999 - RNA, 62 nt, Human
acucgccucccucuauuuauaacuguccccuccaggcugacagugguucaacccugaauccu

SEQ ID NO: 10000 - RNA, 62 nt, Human
gcccucaccaucucaaacucugauucccacuccacucuucgagguuucucucagcuuuuuga

SEQ ID NO: 10001 - RNA, 62 nt, Human
cggcggcggggaggggaggcgggggcgccuccggcggcgagaugcagaggugacccucggac

SEQ ID NO: 10002 - RNA, 62 nt, Human
ugacgcccccgugcagcuugggccggagggcaagggaugccaguaagucugcaggugcgggg

SEQ ID NO: 10003 - RNA, 62 nt, Human
cuuuguauugcccacucauuuguauaagugcgcuucgguacagcacggguccugcucccgcg

SEQ ID NO: 10004 - RNA, 62 nt, Human
aagaagcugaaucuuugggacugauucucaguggagggcuuagaucauacaaaaaucuuuau

SEQ ID NO: 10005 - RNA, 62 nt, Human
gcauucuuuauuuuaaaaagcuuguuuuuacguaaucauagagcuugcuauuuguacaucug

SEQ ID NO: 10006 - RNA, 58 nt, Human
auguggauguacuguuuguauauauuguauauauuaaaacagagauaugugcaugaaa

SEQ ID NO: 10007 - RNA, 62 nt, Human
ccucucuggucauuauuucuuccuacuguguuuaaauauccaccaagugucaaggacuuugu

SEQ ID NO: 10008 - RNA, 60 nt, Human
gauuagcuggcucuguuuuuugguuaaauaagagucuuuaauccuuucuccaucaagagu

SEQ ID NO: 10009 - RNA, 62 nt, Human
gaguuuuguuauuuucuguauagaaagguugagauauaucaacacuuggaauuguuacccau

SEQ ID NO: 10010 - RNA, 61 nt, Human
aaauuuuuuuauguucuuuuuuuuggucacaggaguagacagugaauucagguuuaacuuc

SEQ ID NO: 10011 - RNA, 59 nt, Human
aagaagaugacaaaugcuagaggcugcuccccccuccgaugcaugcucuucucucacau

SEQ ID NO: 10012 - RNA, 62 nt, Human
cacgaggucaagagaucaagaccagccugaccaacguggcgaaaccucgucucuacuagaaa

SEQ ID NO: 10013 - RNA, 62 nt, Human
ccacaggucugacuggcacugccuuuuguuugcccuugaacagggcaguguuguggggacug

SEQ ID NO: 10014 - RNA, 62 nt, Human
ccacacaauaacucuaacuugacuucuaaccauucuaucuuauugauuuggaggcugucuuc

SEQ ID NO: 10015 - RNA, 62 nt, Human
uggaguuucgcucuguugcccaggcuggaguguaauggugcaaucucggcucacugcaaccu

SEQ ID NO: 10016 - RNA, 59 nt, Human
aaaaccuugauuacagccauggggugggggugggggucaggggcgucugacuauggcug

SEQ ID NO: 10017 - RNA, 62 nt, Human
gcccuuucacuggccuggugacuggaaugugggcagcgcccacacaggcucuggcccauggc

SEQ ID NO: 10018 - RNA, 59 nt, Human
gcaguuuguaagauuccuccuaacuuucacagucgaugacaagauugucuuuuuaucug

SEQ ID NO: 10019 - RNA, 62 nt, Human
agugccccacguucugagaaggggccggccggagggaggggacccggcagggagauuucggu

SEQ ID NO: 10020 - RNA, 61 nt, Human
ucuggccuuggccccacagcccagcuccaugaccuucuccagcugaggcaggagaaugccu

SEQ ID NO: 10021 - RNA, 62 nt, Human
gggguagcuaauuucccauuuacaacacagaaaugauauagagcuaguucgcuccaacucuu

SEQ ID NO: 10022 - RNA, 57 nt, Human
guuuguuuguuuguuuuaaucucuacagcacauuuaaugcaacuuuugaaaucugca

SEQ ID NO: 10023 - RNA, 62 nt, Human
ccagaucuuguuauuugauguguuaauaaagaagcacauauauagcaagucaggaaacuuaa

SEQ ID NO: 10024 - RNA, 61 nt, Human
ccaaaacaguuaacucuuucuuuccaaucaauuuauacaaaagaggucgcuccagcccuac

SEQ ID NO: 10025 - RNA, 62 nt, Human
ccgagggcggccagggacagacgcuugcgccgagaccgcagagggaagcgucagcgggcgcu

SEQ ID NO: 10026 - RNA, 62 nt, Human
cuugagcccaggaguucaagacuagccugggcaacacggcgaaaccucgucucuacaaaaaa

SEQ ID NO: 10027 - RNA, 62 nt, Human; identical to SEQ ID NO: 10025

SEQ ID NO: 10028 - RNA, 62 nt, Human; identical to SEQ ID NO: 10026

SEQ ID NO: 10029 - RNA, 62 nt, Human; identical to SEQ ID NO: 9898

SEQ ID NO: 10030 - RNA, 62 nt, Human
cagcgcuguccccacggguaccaggaagugcagagccgcacaggagcugccccggagcugag

SEQ ID NO: 10031 - RNA, 62 nt, Human
cagugccuuugccugcagcuaccuggguaaggacuugccagagaacuacaacgaggccaaau

SEQ ID NO: 10032 - RNA, 62 nt, Human; identical to SEQ ID NO: 9510

SEQ ID NO: 10033 - RNA, 62 nt, Human
accugucacgagccucugcaggugccugcucaccauggcccagcgccacucuguccuccgac

SEQ ID NO: 10034 - RNA, 60 nt, Human
cagccucccgaguagcugggauuacaggcaugugccaccacgcccggcuaauguuuguau

SEQ ID NO: 10035 - RNA, 62 nt, Human
acaauuccccaaagcuguugaaggcugagaccucaaucgguauuuggaaaaugagucaggaa

SEQ ID NO: 10036 - RNA, 59 nt, Human
ugccuuaaacugcaacgucccgucccuuccccacccccaucccauccccacccccagcc

SEQ ID NO: 10037 - RNA, 62 nt, Human
cguucauuuaaacguauauuuagaacugcacuuuguccacaaccuucccuucucuuucuauu

SEQ ID NO: 10038 - RNA, 62 nt, Human
cccaguccacauggaaaacaucagggagugacaauccagcaagaaaucccucgcuaguucca

SEQ ID NO: 10039 - RNA, 62 nt, Human
gaccagcccagaagaggcccacccucucgguccggaacaagacgccucggccacggcucccc

SEQ ID NO: 10040 - RNA, 62 nt, Human
cauuaacugcgugccuggcccuaugagggcggcggcgggacagggugagcggagagacagaa

SEQ ID NO: 10041 - RNA, 62 nt, Human
aacuacagggcggcgggcugcggucagcacgugugcucgggacacagcggagucagggccag

SEQ ID NO: 10042 - RNA, 62 nt, Human
ucagggugggaaguaguacugcuagucauggucucaccccgagcugaccccucugccugggc

SEQ ID NO: 10043 - RNA, 62 nt, Human
acccccacagcacccccacaauguaggaaaagaccucagggaaccucucccuggaaagacgg

SEQ ID NO: 10044 - RNA, 62 nt, Human
aucugcccgcggcugcgugaggacagcagggguuuuucuucagagucuauuuuuucagcgac

SEQ ID NO: 10045 - RNA, 62 nt, Human
acauguauauauguacaacaguguguuuguaaauauauaggaacguuucugaacagggucug

SEQ ID NO: 10046 - RNA, 61 nt, Human
uauuuuuguuuuuaaaauaaugauuguaaaauguuuuacaaguaauguaaaagcuaguauc

SEQ ID NO: 10047 - RNA, 62 nt, Human; identical to SEQ ID NO: 9903

SEQ ID NO: 10048 - RNA, 62 nt, Human; identical to SEQ ID NO: 9904

SEQ ID NO: 10049 - RNA, 62 nt, Human
aaaaaaaaaaaaauuagccggccgugguggcaagugccugaaaucccagguacucaggaggc

SEQ ID NO: 10050 - RNA, 62 nt, Human
uggggcacaacaucccaccgcagucccccucacccgacaacaccuccuaccuggccccuugc

SEQ ID NO: 10051 - RNA, 62 nt, Human
gccauacccaugagcaaacaguuuggcauuaauuauauaucacugccacccucugaacuuug

SEQ ID NO: 10052 - RNA, 62 nt, Human
cuggacugaggccuuugcugugaacugcaguguuucauacgaaccaucuuuccuagugcaug

SEQ ID NO: 10053 - RNA, 62 nt, Human
ccuccccggccccacgacagaguccccucccucugauaucgagacuccagacucagaagucu

SEQ ID NO: 10054 - RNA, 62 nt, Human
uaaaaguguuguaagagacuccugaggaagacacacaguuuauuuguaaaguagcucuguga

SEQ ID NO: 10055 - RNA, 62 nt, Human
ugcccacucccgccagccccugccucgaggacugauacugcagugacugccgucagcuccga

SEQ ID NO: 10056 - RNA, 62 nt, Human
ggugggcuuggguuuuguggagcgcaugcuuggacccuuucaguaaggaagggucuuugggg

SEQ ID NO: 10057 - RNA, 62 nt, Human
aacauuaagaaaauuauggcuguugcugucauuacauaucuauuaaaugucaucaaauaugu

SEQ ID NO: 10058 - RNA, 57 nt, Human
ugcucaggcccuccccucccaugcaggccgaugacaacugcagcccucucugcacuc

SEQ ID NO: 10059 - RNA, 62 nt, Human
uggugccagcagcuggggcagggaagggugggaggggccccauccaaaggaugcccuggcca

SEQ ID NO: 10060 - RNA, 62 nt, Human
cggaguggggguggcggccgccccacccuccccacccggggaagccaucacagcucaucugc

SEQ ID NO: 10061 - RNA, 62 nt, Human
acaguugaagagcaaacagaaagguuuucucuuggugggauaugcagaacuugggaugugug

SEQ ID NO: 10062 - RNA, 62 nt, Human
uucuaaaagccccaacacaugacgccaucugaagacccgcaacggaguggggguggcggccg

SEQ ID NO: 10063 - RNA, 62 nt, Human
uuuagggauuucauguuaucauuuuuaaauaaaguauaacuaugugucucagcuugggcugc

SEQ ID NO: 10064 - RNA, 60 nt, Human
gguggugccagccacuccacagagcccgagggaugaucuagccugauuccugcguguccg

SEQ ID NO: 10065 - RNA, 62 nt, Human
auuuuagcacuugcacuauuacucagcagcaguaacaugguaacacuuaaaaugguacucgg

SEQ ID NO: 10066 - RNA, 60 nt, Human; identical to SEQ ID NO: 9971

SEQ ID NO: 10067 - RNA, 62 nt, Human
uuguggcuuguugaccgggaaugugucaccccugccagggaacucuucuccucgcgggggac

SEQ ID NO: 10068 - RNA, 56 nt, Human
gucuuugcucugcaggaucgggaucagagcgugggaggagguggggguggacgucc

SEQ ID NO: 10069 - RNA, 62 nt, Human
aacugauggcugccacuuccaggccccgagagacaggccucacguaacuuuacugcagccga

SEQ ID NO: 10070 - RNA, 60 nt, Human
cuuccacaaaagauuuggcucuaccuuggaucugcuaguaaauaacuaauaggcaggcag

SEQ ID NO: 10071 - RNA, 62 nt, Human
uuccaaucaauuuauacaaaagaggucgcuccagcccuaccacaggucugacuggcacugcc

SEQ ID NO: 10072 - RNA, 61 nt, Human
guuuucaggaggcccuguucuuagagccccugacaaaggcagcacuuauuuccugggcugg

SEQ ID NO: 10073 - RNA, 62 nt, Human
aaaugccuuaaacugcaacgucccgucccuuccccacccccaucccauccccacccccagcc

SEQ ID NO: 10074 - RNA, 62 nt, Human
agcuugagacaguccaagcuucagcucuggagggcggaggaaagcucauggcauacccaccu

SEQ ID NO: 10075 - RNA, 62 nt, Human
gaagcaaaggaaggacuaaaaagccuccacggacaucgauaaucaagagauuauuaagaucu

SEQ ID NO: 10076 - RNA, 62 nt, Human
gaauuuuuacauuuguuguacaaucaggaaaagcaauaaagauuuuucaaaaauagacaugu

SEQ ID NO: 10077 - RNA, 62 nt, Human
gucacaaucuagcggagaaaggauguuacuagaaguacacaaauugggcccggcgcgauggc

SEQ ID NO: 10078 - RNA, 60 nt, Human
aucaacaaccuguaucugguagcuugcuacccacgaugaagcacuuugaaauuuauuacu

SEQ ID NO: 10079 - RNA, 62 nt, Human
cugucucagcaccauccagccuggcacuucucuucccauauauccauuggauuuuuuuuuuu

SEQ ID NO: 10080 - RNA, 60 nt, Human
ucuuuuuaaguaaaaacaacaaauaaacucuguacauguaaaacgugagaaauuguccug

SEQ ID NO: 10081 - RNA, 62 nt, Human
uccuggcuguugacuucccauugcucuuggagccaccaaucaaagagauucaaagagauucc

SEQ ID NO: 10082 - RNA, 62 nt, Human
uccuucuggcucaggugaaauccaugcccuucugcuuauagaccuaaaguucagguacuuau

SEQ ID NO: 10083 - RNA, 62 nt, Human
ugcuuugccaguugucuugggauuguuuuacaccauccuuuacuucccuugcucagaccucu

SEQ ID NO: 10084 - RNA, 61 nt, Human
cuguaucaugcggcugaauucccuuuuuccuuuacucaauaaaagcuacaucagacugaug

SEQ ID NO: 10085 - RNA, 62 nt, Human
acuaaccgugaccacuacuccaaacaaaacacaauaugccuaggggcacggaugaacgucca

SEQ ID NO: 10086 - RNA, 62 nt, Human
gagaagaaugaaauaagacgugaaguguaggaaaucaugaaaagaacaauuuugcaaauugc

SEQ ID NO: 10087 - RNA, 62 nt, Human
ugccuaagccucccgaguagcugcgacuacaggcgccggccagcaugccugucuaauuuuug

SEQ ID NO: 10088 - RNA, 60 nt, Human
ggcccugagaugugaggucugcugcuucacuggggcccgaugacuuuggcugggggaggg

SEQ ID NO: 10089 - RNA, 62 nt, Human
cugaggguggccaccacagccuuggcuccaugguggcggguagacaagggaugccugggcug

SEQ ID NO: 10090 - RNA, 62 nt, Human
ggaggcagaaccggagucggguuuggggaaguugucaaggaaugagggaaaguaaauccuca

SEQ ID NO: 10091 - RNA, 62 nt, Human; identical to SEQ ID NO: 9270

SEQ ID NO: 10092 - RNA, 59 nt, Human
accccaagucauacacuggacccagugccugcggggacaggacuguggguuucuugguc

SEQ ID NO: 10093 - RNA, 62 nt, Human; identical to SEQ ID NO: 10059

SEQ ID NO: 10094 - RNA, 62 nt, Human; identical to SEQ ID NO: 10060

SEQ ID NO: 10095 - RNA, 62 nt, Human
cgcaggacccuuguccugguggcacaagggauggggacgcgagggggaggggaggcgaggaa

SEQ ID NO: 10096 - RNA, 62 nt, Human
caaacaugucuuuguaucaaggaacuuaaaauuucucaacaauuguauuuugaacacuguua

SEQ ID NO: 10097 - RNA, 62 nt, Human; identical to SEQ ID NO: 9290

SEQ ID NO: 10098 - RNA, 62 nt, Human
gggcuuggguuuuguggagcgcaugcuuggacccuuucaguaaggaagggucuuugggguuu

SEQ ID NO: 10099 - RNA, 62 nt, Human
cucuuaguugagcacagaacccucagcucuggugcgggcagaucccugccauuuaggugccu

SEQ ID NO: 10100 - RNA, 60 nt, Human
gguucugguuuaacuaauauuugucugugugcuacuaacagauuauaauaaauugucauc

SEQ ID NO: 10101 - RNA, 62 nt, Human
cuacuugcacugcuguggauuuuuuuaagagaagcaaaaacaaaaguaaacuccuuucccug

SEQ ID NO: 10102 - RNA, 62 nt, Human
gaugagaagggagcagggagaguuccagaaagggggaugaaauaggaguauuaaaaagcugc

SEQ ID NO: 10103 - RNA, 62 nt, Human
cguucccuccuagucucuguucgcucgcuuaagcuguuuugaagccaagugaagaguguggu

SEQ ID NO: 10104 - RNA, 56 nt, Human
uaucaaugaagucauccuuuagacuuguaaucgccacauuguuucauuauucaguu

SEQ ID NO: 10105 - RNA, 62 nt, Human
gugaauucuuugcauguucaaaacggaaaccauugauuagaacuacauucuuuaccccuugu

SEQ ID NO: 10106 - RNA, 62 nt, Human
ccaugauugcuuuugagggcccggaauuauaaauauauauuauauuuuaauuguuugagauu

SEQ ID NO: 10107 - RNA, 62 nt, Human
ggauguuguuccuuuuuugaaguugucauuaaaguaggugcaacaaccaagaaagugucucu

SEQ ID NO: 10108 - RNA, 61 nt, Human
uucuuucuuuuuuuuuguucguucauuuaaacguauauuuagaacugcacuuuguccacaa

SEQ ID NO: 10109 - RNA, 62 nt, Human
uagacuuuguggcucuaaaguaccugucuguugagauuucaagucucuugucaccauccuca

SEQ ID NO: 10110 - RNA, 62 nt, Human
agugaacugcuguuugccugauugguaaaccaacacacuacaauugauaucaaaagguuucu

SEQ ID NO: 10111 - RNA, 62 nt, Human
ggagauccacagcucacggagccuggccgcggaccccucccaccccugccuugccggccccu

SEQ ID NO: 10112 - RNA, 62 nt, Human
gucuaggugguugaaggauguaguagaaggauggaugguggaagguggggacguugguggcu

SEQ ID NO: 10113 - RNA, 62 nt, Human
uuuagaaacugacgagggcaaacagccaggacgcauuggagaggaauuugccaaagaucuac

SEQ ID NO: 10114 - RNA, 62 nt, Human
uuuuuuuucuuccuauuuuuguuuguuuauacaaauaucugauuugcaagaaaaagugcaug

SEQ ID NO: 10115 - RNA, 57 nt, Human
cagccccaggcccagcugccuuuggcuuugaucucaagucaggcugaaggcagcgaa

SEQ ID NO: 10116 - RNA, 62 nt, Human
ucauuugauugcuugauaaggccucaggaucucagcauugcacaaugccucauggaagccuu

SEQ ID NO: 10117 - RNA, 62 nt, Human
ggaacauucuaacauuuacacuuuuguuauaagcuauuuaaaaccaguaaggagacuugaaa

SEQ ID NO: 10118 - RNA, 62 nt, Human; identical to SEQ ID NO: 9931

SEQ ID NO: 10119 - RNA, 59 nt, Human
gccaaggugggcugagcccuggcaggaugacccugcgaaggggcccugguccuuccagg

SEQ ID NO: 10120 - RNA, 62 nt, Human
gaucuuccucagaggaggccucagcaagugucagccacacgaaugaguguauggagcaaagg

SEQ ID NO: 10121 - RNA, 62 nt, Human
ugcauaugcaucccaagauuauauuauuguuuucuacugcuaugugucacacuuugccaaac

SEQ ID NO: 10122 - RNA, 62 nt, Human
uaugucaaauguaacguuuauuuuuuuaaacaauaaaauugauuugccaaaauccgggcuuu

SEQ ID NO: 10123 - RNA, 62 nt, Human
ugacagccugcauuugcuagacgguuggugaguggcaucaaaugugugacuuacuaucuugg

SEQ ID NO: 10124 - RNA, 62 nt, Human; identical to SEQ ID NO: 9372

SEQ ID NO: 10125 - RNA, 62 nt, Human
uuuaauacacguaaucuuuuugaagcagacauuguauacagaaucuuacuucucuuuguucc

SEQ ID NO: 10126 - RNA, 62 nt, Human
cuguuccggaggcgcugggucgggaugccgaaccucuccugauccgccggcagcaacgagcc

SEQ ID NO: 10127 - RNA, 62 nt, Human
ugccaaauuauguuagcgugcaccaucgugucacgucgacgauuauaauuuuuuagaaaaac

SEQ ID NO: 10128 - RNA, 62 nt, Human; identical to SEQ ID NO: 9795

SEQ ID NO: 10129 - RNA, 62 nt, Human
uugcacuccagcccgggcgacagagcgagacuccaucuaccagauccuuaugacgcagcuga

SEQ ID NO: 10130 - RNA, 62 nt, Human
ccaucugcagauuauucccagucucccaguaacacguuucuacccagauccuuuuucauuuc

SEQ ID NO: 10131 - RNA, 62 nt, Human
aaggaacuugaagacauacagcagcaucccuuagcaaugugacauugcuuuucagacuguuu

SEQ ID NO: 10132 - RNA, 62 nt, Human
ccggugccccguacccuguauuuauucuuuuaacaauaacaaaagccauuuauuuauuccau

SEQ ID NO: 10133 - RNA, 60 nt, Human
uuuuaaugauuuuuuaauuaaaaaaaagaacaacaggauagagcuguugggguggcacag

SEQ ID NO: 10134 - RNA, 62 nt, Human
caucuguuggaagacuuuuaagugaguuuuuguucuuagauaacccacauuagaugaaugug

SEQ ID NO: 10135 - RNA, 61 nt, Human
ugguucugguuuaacuaauauuugucugugugcuacuaacagauuauaauaaauugucauc

SEQ ID NO: 10136 - RNA, 62 nt, Human
gcagcacgggcgugaaggucggaggacagagaaaggucagcagggucagaguaugugagguc

SEQ ID NO: 10137 - RNA, 62 nt, Human
ugcacuaauucuagaugucuaauucaggauacugucuauagaaaggcauucuuaaaaguuaa

SEQ ID NO: 10138 - RNA, 62 nt, Human
ggagaagcacagggcuccacccugcaagcggcaucuggcggacccucaugagccugucgugc

SEQ ID NO: 10139 - RNA, 62 nt, Human
gugggcacguggaggaagggucugaaggaaggcuccggagcacaggcccugguguuccugug

SEQ ID NO: 10140 - RNA, 62 nt, Human
cccccucugccccacgugccggcccuccuggugcucuauccacugcagggccagccacucgc

SEQ ID NO: 10141 - RNA, 62 nt, Human
uuagaauggaacugccggcccuggcaacugucacgugugcuagaagguucgaugccucugga

SEQ ID NO: 10142 - RNA, 62 nt, Human
agaguuaagauguucuaugucaauuugcucuugccgaaaagaugagccucgauuuuaaaauc

SEQ ID NO: 10143 - RNA, 62 nt, Human
ggacauuuuaucauuuucaaauguuucucacaauguauguuauaguauuauuauuauauauu

SEQ ID NO: 10144 - RNA, 62 nt, Human
aggagcugcaccgagaccucaccaagcaccacucgcucaucaaggcggagaucaugggagac

SEQ ID NO: 10145 - RNA, 61 nt, Human
cagucugcccuaucaagcccagugacucagaucgcauugaaccuaaagcugugaaggcuuu

SEQ ID NO: 10146 - RNA, 62 nt, Human
cuuaacauacuugaauucucaaauuuccuuugggguaaaaaaaaaaaaaggauuugaaacca

SEQ ID NO: 10147 - RNA, 60 nt, Human
cccuccauaauuaagaugaaacauuccgguuuucucacaacacauuagcacauacugucc

SEQ ID NO: 10148 - RNA, 62 nt, Human; identical to SEQ ID NO: 10146

SEQ ID NO: 10149 - RNA, 60 nt, Human; identical to SEQ ID NO: 10147

SEQ ID NO: 10150 - RNA, 62 nt, Human; identical to SEQ ID NO: 10146

SEQ ID NO: 10151 - RNA, 60 nt, Human; identical to SEQ ID NO: 10147

SEQ ID NO: 10152 - RNA, 62 nt, Human
ggcaugugccaccacgcccggcuaauguuuguauuuuuaguagagacgggguuucaccaugu

SEQ ID NO: 10153 - RNA, 62 nt, Human
ucacguuuccauaucuccugcuggaaaucagaaaauauaauaaaauugcacaaaaaaaaaaa

SEQ ID NO: 10154 - RNA, 62 nt, Human
auacaugcauauagacgcaucuauuggaaaugcaguuccacaggugagcauguucuuucugg

SEQ ID NO: 10155 - RNA, 62 nt, Human
cagcucuccccagugccuuuuggccacugcagcuaccguagaauggcauuuuauauguaccu

SEQ ID NO: 10156 - RNA, 62 nt, Human
ucacucaacucuggggaaugcuaccauuuuuuuuccaaaguagaaaggaagcacuucugagc

SEQ ID NO: 10157 - RNA, 62 nt, Human
uacuaacuagucuuuggaauucgugaccuauggagacaguaauuaucaauuuauugauucua

SEQ ID NO: 10158 - RNA, 62 nt, Human
gcgcugaagugugaccugaccguguggaaccaaacccuuccagcgucucugcucacuuagcu

SEQ ID NO: 10159 - RNA, 62 nt, Human
ucccaguggccucaccucucugugccucgaugucuucaucuacgauacuucugguucccucc

SEQ ID NO: 10160 - RNA, 62 nt, Human
uuagauugagcugggcagcugcaaucagcuucuuuauaugcaaauuaggcacgacccaucug

SEQ ID NO: 10161 - RNA, 62 nt, Human
guacugggucaccacaucccagagccuugcucaguuauagcaacugcugcgggcgugcacau

SEQ ID NO: 10162 - RNA, 62 nt, Human; identical to SEQ ID NO: 9348

SEQ ID NO: 10163 - RNA, 62 nt, Human; identical to SEQ ID NO: 9349

SEQ ID NO: 10164 - RNA, 62 nt, Human
gaguaauuuacaaacacaacugcauucauaaaugggaauagaacgugaaagccagcucuuuc

SEQ ID NO: 10165 - RNA, 62 nt, Human
aaaacaaaacaaacaaaacaaaacaaaaaagacaaaaccuaaaacugagcuaucuaaggggg

SEQ ID NO: 10166 - RNA, 62 nt, Human
gaaguccccgcccuugggacagccuccuccguagccccugcacggcaccaguuccccgaggg

SEQ ID NO: 10167 - RNA, 62 nt, Human
cuuguccccugggggacccagacaaagcacagcagccgcucagagacaggaauagaaauuuc

SEQ ID NO: 10168 - RNA, 62 nt, Human
aucacaacgaccuuuucaaguaggcauuaucaccaugcgacagguugaggaccgugaggcac

SEQ ID NO: 10169 - RNA, 60 nt, Human
ccauguuggccaggguggucucaaucuccugaccucgugauccacccaccucgaccuccc

SEQ ID NO: 10170 - RNA, 62 nt, Human
cugacucgugucuuuuuacccccaagauaucugucuucaguagcgacugaaucugccacucu

SEQ ID NO: 10171 - RNA, 60 nt, Human
aaaagaaaaugugacuucaaaggaaaggaacaaauuuucaaagacuugggggagugaagg

SEQ ID NO: 10172 - RNA, 62 nt, Human
ccaaaagaugccuugaauauuuauucagugacuucuggcuuaugcucagaagccagucugcg

SEQ ID NO: 10173 - RNA, 62 nt, Human
uguuuuuagcagagacaugcaacaacaacacacacgcacacacgcacacacacacacguaca

SEQ ID NO: 10174 - RNA, 62 nt, Human
gaaugagugcuaugguguugaaaacugcaguguccguuaugagugccaaaaaucugucuuga

SEQ ID NO: 10175 - RNA, 62 nt, Human
ccuucuguugagaauuaucaccaugacaccugccauaccguauagagagccaagguacagcc

SEQ ID NO: 10176 - RNA, 62 nt, Human
guggguggggugauggcucuggggagcggcugccauccuacaagccacacccccuccucuga

SEQ ID NO: 10177 - RNA, 62 nt, Human
guuggaagacuuuuaagugaguuuuuguucuuagauaacccacauuagaugaauguguuaag

SEQ ID NO: 10178 - RNA, 62 nt, Human
ucauguagaauaaaaauuuuaaaucucacuucacuuagccgacauuccaugcccugaccaau

SEQ ID NO: 10179 - RNA, 52 nt, Human
aaaaaggccaaggaacuugaagacauacagcagcaucccuuagcaaugugac

SEQ ID NO: 10180 - RNA, 62 nt, Human
gguucccuuuuaaaaaugugauuguuaaccugccucuugaaagauucaaccggguguggugg

SEQ ID NO: 10181 - RNA, 62 nt, Human
aggcguuuuugagaguggaaaagaaauuuaaacuucccgaaagaagguccaccaucaggaga

SEQ ID NO: 10182 - RNA, 62 nt, Human
gcacacgugccgccugaccgggcgacccuuuucaguucggcaaacgucgcucccuucauuuu

SEQ ID NO: 10183 - RNA, 62 nt, Human
agccugugcugaccuuggggaaucugagcuuuuccaaggguaaggggcccaggguaugcagg

SEQ ID NO: 10184 - RNA, 62 nt, Human; identical to SEQ ID NO: 9497

SEQ ID NO: 10185 - RNA, 62 nt, Human
uaauaauuuuuuucccugauggaauuuaccuuaaucuguauauaacuuguaauuuuuucuaa

SEQ ID NO: 10186 - RNA, 62 nt, Human
auaaagacauuaagaaguggauggauguuguuccuuuuuugaaguugucauuaaaguaggug

SEQ ID NO: 10187 - RNA, 61 nt, Human
caugggagcugccucuuuggaagugcagauuuauuccuguaauaauccugccugcuuuuac

SEQ ID NO: 10188 - RNA, 62 nt, Human; identical to SEQ ID NO: 9827

SEQ ID NO: 10189 - RNA, 60 nt, Human
gagccaccgugccuggucuguuuuuuuuuuuuuuuuggcaauagagucuugcucgcccag

SEQ ID NO: 10190 - RNA, 62 nt, Human
uccaguagcuccuggaaaaaaccuuaaaaaauguuuccuccaaaucugauuucauuacauuu

SEQ ID NO: 10191 - RNA, 54 nt, Human
ugucugaggccgcccugucagcuggccgguccaagccuguggcuggagcuggug

SEQ ID NO: 10192 - RNA, 62 nt, Human; identical to SEQ ID NO: 10190

SEQ ID NO: 10193 - RNA, 54 nt, Human; identical to SEQ ID NO: 10191

SEQ ID NO: 10194 - RNA, 62 nt, Human
accugccuucuggcggcaccucccgggugcuguguugagucagcaggcauggggugagagcc

SEQ ID NO: 10195 - RNA, 60 nt, Human
ccaagugaagagugugguuugcauccaagagaaaacaccacacugugaugucaucgggaa

SEQ ID NO: 10196 - RNA, 62 nt, Human
aaugaacacugcucuucagcaguucaaguacuuguucucaaaacauuuucuaauugauuggu

SEQ ID NO: 10197 - RNA, 61 nt, Human
aucugccagacauucuaauuugaaccagauaucucuggguagcuacaaaguuccucagggg

SEQ ID NO: 10198 - RNA, 62 nt, Human
ccuggguggggacugggcugugcccagggccucugucccccaggaugucuuguggugcgggu

SEQ ID NO: 10199 - RNA, 61 nt, Human
ccucucagugugggcagcccucgcaugcuggggucgggccagcucuccccgaaaggucuug

SEQ ID NO: 10200 - RNA, 62 nt, Human; identical to SEQ ID NO: 9917

SEQ ID NO: 10201 - RNA, 62 nt, Human
cccauccagaccccgacuggccaagaccuccacguccccagaguccagcccuggaaauucca

SEQ ID NO: 10202 - RNA, 62 nt, Human
uucccagacccagaaagcuuuacagaaaaucauuguaagacaauuuauuaauuugagaaagu

SEQ ID NO: 10203 - RNA, 61 nt, Human
agcaggggcagggugauaaauuguugauaaauuccacuggacuugagcuuggcagcugaac

SEQ ID NO: 10204 - RNA, 62 nt, Human
uaccgguacaucccguucacacaugggaagagaagguacagaggcaaggaggaugccggcaa

SEQ ID NO: 10205 - RNA, 55 nt, Human
ggauaugcuccuggguggggacugggcugugcccagggccucugucccccaggau

SEQ ID NO: 10206 - RNA, 62 nt, Human
gacuccugaagccccgcugcugagaugggcgcucccgacacagcgcagacccaccaggagga

SEQ ID NO: 10207 - RNA, 62 nt, Human
gaauuagauguacagugaagggaaaagaaaaaaaaugggcgaagagaggguggaaaauaaaa

SEQ ID NO: 10208 - RNA, 62 nt, Human
cacagacaucugaaaagugaauggccaagcuggucuaguagaugaggcuggacugaggaggg

SEQ ID NO: 10209 - RNA, 62 nt, Human
aggccccugugagggccagcucuggaaaaaccugggaguugaugccggaggcuguggaagaa

SEQ ID NO: 10210 - RNA, 62 nt, Human
aggugguggaaggggccaggggccugcaggccucccccuggaacugggacuggucucggucu

SEQ ID NO: 10211 - RNA, 62 nt, Human
cccaucagcaucccacgaucggccuugguaaccgccgcgguagaucauuuuuaucccgccag

SEQ ID NO: 10212 - RNA, 62 nt, Human
cacgcguuuccacaacauccccugggucagacccaccagguaccccguaggaauuuccaguu

SEQ ID NO: 10213 - RNA, 62 nt, Human
cccuuugcccuauuuucuguucaguuuuuuaaaaguguuguaagagacuccugaggaagaca

SEQ ID NO: 10214 - RNA, 62 nt, Human
ugggcgugggccgcacagcgcggcagggccuuggcuaccacacgcggcaucgcuccuugggg

SEQ ID NO: 10215 - RNA, 62 nt, Human
uuggccaucuagcauuccauacaaaauuguuuccuauaagcauuccuuuuauucucuauucu

SEQ ID NO: 10216 - RNA, 62 nt, Human
ucagcuuuuacuggaaacugcugucuaggaccaccugcccuaaccaggaauaaaggcaagac

SEQ ID NO: 10217 - RNA, 60 nt, Human
gcagaaccgaugagagccgcccuuaccguuggucuccggaucccccagucccaucccgcc

SEQ ID NO: 10218 - RNA, 62 nt, Human; identical to SEQ ID NO: 9529

SEQ ID NO: 10219 - RNA, 60 nt, Human
acuucaaaggaaaggaacaaauuuucaaagacuugggggagugaaggcagagccuggugc

SEQ ID NO: 10220 - RNA, 62 nt, Human
cugcaguugcaaguauguuuacaccugguguccaauuuuguauuuuaaaauguaauccauuu

SEQ ID NO: 10221 - RNA, 59 nt, Human
guaagcuaacagucuugcuuaguauucaagaaaauccaaacugugucuguuuccuucca

SEQ ID NO: 10222 - RNA, 62 nt, Human
gccagcugugaggagaaagcagcuggcaguguuaggacauuaguccaccuucagcgcagggu

SEQ ID NO: 10223 - RNA, 62 nt, Human
cccaccaagugccucccucuuuaauuagaggucaucauggaaauggucgggauauuuacgug

SEQ ID NO: 10224 - RNA, 62 nt, Human; identical to SEQ ID NO: 10129

SEQ ID NO: 10225 - RNA, 53 nt, Human
ggacagccucgaccgagacaaggaggcccuuaaaugacagccugcauuugcua

SEQ ID NO: 10226 - RNA, 62 nt, Human
ucuucguuguuguuguuuuuaauuguaaauuguuaucaaucaaacuauuguagcagcuacaa

SEQ ID NO: 10227 - RNA, 58 nt, Human
uuccuuucagauccuccacuuggcaggcagggccaacagcagcccccgggccaggugu

SEQ ID NO: 10228 - RNA, 62 nt, Human
uuucuuuaacgucuguucccuuaacaucgcugaaaugauuuacuguugaagagaugccuugc

SEQ ID NO: 10229 - RNA, 62 nt, Human
auuacacacaugugcgcauuacacacacacaauacacauacaugcauauagacgcaucuauu

SEQ ID NO: 10230 - RNA, 62 nt, Human
caauuaauacggaaaucgcugugggagaagaaugaaauaagacgugaaguguaggaaaucau

SEQ ID NO: 10231 - RNA, 62 nt, Human
gggucuuggguacgagaauucccucaucuuucucuacuguaaagugauuuuguuugcaggua

SEQ ID NO: 10232 - RNA, 62 nt, Human
ugagggagcacuucccaggggccgcagggacgacacucuccagggaggccccagcaaccaca

SEQ ID NO: 10233 - RNA, 62 nt, Human
agaagcauuuuccccauguggcucucucacugugcguugcuaccuugcuucugugagaauuc

SEQ ID NO: 10234 - RNA, 62 nt, Human
ucuuucuuuuuuuuuguucguucauuuaaacguauauuuagaacugcacuuuguccacaacc

SEQ ID NO: 10235 - RNA, 62 nt, Human
gggggcugcacccccacagcacccccacaauguaggaaaagaccucagggaaccucucccug

SEQ ID NO: 10236 - RNA, 62 nt, Human
augagcagucagagagucuacagaacacgcacgacgacagcaggaacaacgcggccucagcc

SEQ ID NO: 10237 - RNA, 62 nt, Human
auguggcaccuuugugccaggccaccaggcagacucuucccaccuucucccacugaagcacc

SEQ ID NO: 10238 - RNA, 62 nt, Human
uaggcccugagaugugaggucugcugcuucacuggggcccgaugacuuuggcugggggaggg

SEQ ID NO: 10239 - RNA, 57 nt, Human
cuggggagcaaucccagcggaucgcuccgggccaccaagccgcaccugugccugaga

SEQ ID NO: 10240 - RNA, 62 nt, Human
accagaaccaccaccuggagaugaucgccgucgccgacgagacgcugaacgaggccaagcag

SEQ ID NO: 10241 - RNA, 62 nt, Human
cuccugauuugacaaaggagcuugccuccuuugaaugaccuagagcacagggaggaacuugu

SEQ ID NO: 10242 - RNA, 62 nt, Human
cugcagccugugucuccugggcaguggcgugaucucgagucacucugucgccaggcuggagu

SEQ ID NO: 10243 - RNA, 62 nt, Human
ggagggaggccugacuucagcaacagcugugggugggcuggaggccggcgcagcuuggggcc

SEQ ID NO: 10244 - RNA, 62 nt, Human
caguccaguguccaucugcauuugcucaugcagagggggugaguugggcacucccuguuguu

SEQ ID NO: 10245 - RNA, 62 nt, Human
cacccccagccccagcccaguccuccuaggagcaggacccgaugaagcgggcggcggugggg

SEQ ID NO: 10246 - RNA, 62 nt, Human
ggaguuugaauuucacaaagcuuuuuuuaucuucaguuccuaaaauauaaucugauaauuaa

SEQ ID NO: 10247 - RNA, 60 nt, Human
aauauuuuuaaggaaaacuguuguauaaaacuuuaccauaguaaccuuagaccuuagaga

SEQ ID NO: 10248 - RNA, 62 nt, Human
cagguucuagaagaaacuggcgcuuaaaccaaaucgcauggauuucuuuuucagugacguuc

SEQ ID NO: 10249 - RNA, 61 nt, Human
ggacgcagcggcaccccucgguuauuaaggagggaggaguaggggauagaaguauuucaaa

SEQ ID NO: 10250 - RNA, 62 nt, Human
aggccaagcccuggaaucccagcccugggucuggcuuggggaggagaaccuuaaagcccuca

SEQ ID NO: 10251 - RNA, 62 nt, Human
auaucuaauuacaggagaauuuacaacaucucaaguacguaaauuaaguugucauugaguga

SEQ ID NO: 10252 - RNA, 62 nt, Human; identical to SEQ ID NO: 9897

SEQ ID NO: 10253 - RNA, 62 nt, Human; identical to SEQ ID NO: 9898

SEQ ID NO: 10254 - RNA, 62 nt, Human
ggagcgcgcagggugggcggcgcagguucuuccccgcgcggauccaacaccacguccugccg

SEQ ID NO: 10255 - RNA, 60 nt, Human
aggaggaggguggguggguccuuguguggccuggcgcgcaccacagggcagcacgggaga

SEQ ID NO: 10256 - RNA, 62 nt, Human
gcggcacugcaaagagacgcuucaaguggggagaagcggcgauaccauagaguccagaucuu

SEQ ID NO: 10257 - RNA, 62 nt, Human
cucuguguugagguugccggggguagggguggggccacacaaaucuccaggagccaccacuc

SEQ ID NO: 10258 - RNA, 62 nt, Human
uucuuugcucauguugcccauucauguuaagaagcgucuucaucuaguguugcugucuugga

SEQ ID NO: 10259 - RNA, 60 nt, Human
caccugugcggcgcuugcuccgaggggucagcaagagcaacugauggcugccacuuccag

SEQ ID NO: 10260 - RNA, 62 nt, Human
cagcgaggcugggucacaggucagggagguccuggccguccacagggucggcccucagcuca

SEQ ID NO: 10261 - RNA, 62 nt, Human
uucauuuugggacugaggcugcagcauuggaacaaaagagcauuauuucaauuuuucuuucu

SEQ ID NO: 10262 - RNA, 62 nt, Human
uuguacagaucccagcuuauggccuugacccagccguccucacagaugccgggugacccucu

SEQ ID NO: 10263 - RNA, 60 nt, Human; identical to SEQ ID NO: 10259

SEQ ID NO: 10264 - RNA, 62 nt, Human
ggcuguggagcaagaggcccugggucucuccaagcagcugcagaccccagcucgaauuuugc

SEQ ID NO: 10265 - RNA, 62 nt, Human
ccgggaccgcacugacaggaaaccuuccgucgugagggagcacuucccaggggccgcaggga

SEQ ID NO: 10266 - RNA, 62 nt, Human
ucgccggacaaugucgaaguccagucugugccggggaaggcacugguuaggaaggauguuca

SEQ ID NO: 10267 - RNA, 61 nt, Human
auuugcaccuuaggagaggcagauguuaaaauggaauccaaagaccaccuagggcggggcu

SEQ ID NO: 10268 - RNA, 62 nt, Human
ccagguaccagaaaccaccaguagagccaccagguacgacgaccccucgacccccagccugg

SEQ ID NO: 10269 - RNA, 62 nt, Human
ucuccugaagauuuaauugcuauuguuacccauucgaaaucagcuguacugugugaacgaaa

SEQ ID NO: 10270 - RNA, 62 nt, Human
ggaguuugugaaaugaauguuuucaagacgcaaacgcugcuaugcccaucaggugugcacag

SEQ ID NO: 10271 - RNA, 58 nt, Human
auaauccaggaagugucccggaaaagagagagaagacaucagagccuaaaggaaacag

SEQ ID NO: 10272 - RNA, 62 nt, Human
acaccacagccuucuccagagccggcacugucccggcaaccaggggugccccaggcuagcuc

SEQ ID NO: 10273 - RNA, 62 nt, Human
uuguaaaagugaugccucuugaaaaaaaaacaguccuauucacuagcuuuuaguaaaagaau

SEQ ID NO: 10274 - RNA, 62 nt, Human
auauccacggaguccuuggauccagugcuacgucaguaaauagcaccagcauuuugcaauug

SEQ ID NO: 10275 - RNA, 62 nt, Human
cuaaacauccuauaaugcacagggcaguaccccacaacgaaaaauaaucuggcccaaaaugu

SEQ ID NO: 10276 - RNA, 62 nt, Human
uggcaagugccugaaaucccagguacucaggaggcugaggcaggagaaucacuugagcccgg

SEQ ID NO: 10277 - RNA, 59 nt, Human
gacugucuuccucaucucuguagcaccaagccugauagaucuguauaugguaaacaggg

SEQ ID NO: 10278 - RNA, 62 nt, Human
caccaugcgacagguugaggaccgugaggcacgcuggaguuauuugacucgacuugcccagg

SEQ ID NO: 10279 - RNA, 62 nt, Human
uggccaacaggguagauuucucuugggcaggcagagaguacagacugcagacauucucaaag

SEQ ID NO: 10280 - RNA, 62 nt, Human
cacauugguccuaaaggggcugaagagccugaacugcaccuaacgggaaagaaccgacaugg

SEQ ID NO: 10281 - RNA, 60 nt, Human
uaaccuccccuccagccagagauauuccaacucugcaauaaaacucuccuucacacagaa

SEQ ID NO: 10282 - RNA, 62 nt, Human; identical to SEQ ID NO: 9320

SEQ ID NO: 10283 - RNA, 62 nt, Human; identical to SEQ ID NO: 9514

SEQ ID NO: 10284 - RNA, 62 nt, Human
agcagcccacaggugauccuaacauaucaggccauggacucaggaccugcccggugaugcug

SEQ ID NO: 10285 - RNA, 60 nt, Human
acuuuuccagaugaacggacaguggggagugggcggugaacuuccaggagggggaagagg

SEQ ID NO: 10286 - RNA, 62 nt, Human
uacuuagugcuaaauacuguuacucaguuuuaaaugccacgacuaggggaaaaagaaacuau

SEQ ID NO: 10287 - RNA, 60 nt, Human
cggcaaggcacggacgacugugcagacacagcagcggcaagaagcgagaacugcccuccc

SEQ ID NO: 10288 - RNA, 62 nt, Human
acugucagagcaugaggagcgcuccuccuguggguggacgcauucacgcacucccagguugc

SEQ ID NO: 10289 - RNA, 60 nt, Human
uucucucugacuauacuuaguuugaaauggugcaggcuuagucuuaagccuccaaaggcc

SEQ ID NO: 10290 - RNA, 62 nt, Human
guacaguauaugucuuucugcuugugaucagcuuugacaacagugacagccccacaacuagu

SEQ ID NO: 10291 - RNA, 55 nt, Human
cagcgagaaguacugugaugacuuugagccguugacauguaugucuucagaugcc

SEQ ID NO: 10292 - RNA, 62 nt, Human
guugcucagguguugcacaauuuuuaucuaacacugaggcuaucagcuccaacuaaacaaca

SEQ ID NO: 10293 - RNA, 58 nt, Human
ccacccuagcugaucaauguacuuugcaaucucccccacccuuaagaagguucuuugu

SEQ ID NO: 10294 - RNA, 62 nt, Human; identical to SEQ ID NO: 9654

SEQ ID NO: 10295 - RNA, 62 nt, Human; identical to SEQ ID NO: 9655

SEQ ID NO: 10296 - RNA, 62 nt, Human
uuaagaguucagaauaacaucuuauuucaguuuaugaauugauaugaauugucuaauuuaaa

SEQ ID NO: 10297 - RNA, 56 nt, Human
uuuucaaguacaaaacuuuuuguccuguaagauauaugcagccucacagaagcagc

SEQ ID NO: 10298 - RNA, 62 nt, Human
cagguggggcagccugaacccugcuucccccuguggccggcaugccccgaucuuucacacac

SEQ ID NO: 10299 - RNA, 57 nt, Human
cgugcagcugucccauccagaccccgacuggccaagaccuccacguccccagagucc

SEQ ID NO: 10300 - RNA, 62 nt, Human; identical to SEQ ID NO: 9431

SEQ ID NO: 10301 - RNA, 62 nt, Human
aucuccagcuugguguuccauggccccuaggcgaggugaucagggaguggggccaaugggcc

SEQ ID NO: 10302 - RNA, 62 nt, Human; identical to SEQ ID NO: 9513

SEQ ID NO: 10303 - RNA, 59 nt, Human
ucucagcacucacgcacugcacaagauggcagcaggauacagcacugcacaagauggca

SEQ ID NO: 10304 - RNA, 53 nt, Human
acgagcccuccccauccugaguccacagggagauccacagcucacggagccug

SEQ ID NO: 10305 - RNA, 62 nt, Human
acagccggaagcugagaccaaggcuccucacagaagggcccaggaaguccccgcccuuggga

SEQ ID NO: 10306 - RNA, 62 nt, Human
ggcagcccgagaccugcacagaugaaggagcagagguucugaccgagaggcugagccaggcc

SEQ ID NO: 10307 - RNA, 55 nt, Human
cccuuguguguguguguugaucccaagacaaugaaaguuugcacuguaugcugga

SEQ ID NO: 10308 - RNA, 62 nt, Human
acguugguggcuggcugaggugcaugggccccacacaggacagcuggagaaugggccgucca

SEQ ID NO: 10309 - RNA, 62 nt, Human
cuacuguuuauuuuucccugcugugcccagaacauuggcguagacacaguaagaaccuagua

SEQ ID NO: 10310 - RNA, 62 nt, Human
cugccgggacccuuucacugccccgguggagugaauagaggaugaggggcccugacccugug

SEQ ID NO: 10311 - RNA, 62 nt, Human
cugagcuagggaauguuggagauucagaggcugaaucagauagcagcccaacccugagauac

SEQ ID NO: 10312 - RNA, 62 nt, Human
cgcgauggcaaugccgagagugcccucuacuguccgacuccagcacugcaacagcuucaagu

SEQ ID NO: 10313 - RNA, 62 nt, Human
ccucuccaagcgccuggcuuuggaaugcuccaggcgcgccgacgccugugccaccccuuccu

SEQ ID NO: 10314 - RNA, 62 nt, Human
gcgaggcugggucacaggucagggagguccuggccguccacagggucggcccucagcucagc

SEQ ID NO: 10315 - RNA, 60 nt, Human
uccaagccuguggcuggagcugguguguguuuaucuaauaaagucccacaggugccucac

SEQ ID NO: 10316 - RNA, 62 nt, Human
acugaucugcugggugacuuucauuccaguugcugggacggaaggcugaauguagggucauu

SEQ ID NO: 10317 - RNA, 62 nt, Human
ugggaguuuguggccacuggguauguguggcuaccgcggguaugcgagugccagauauuggc

SEQ ID NO: 10318 - RNA, 62 nt, Human
ugagcaggagauuuaugaagguuccagacaguuggcugccgagugaacccucugucccugag

SEQ ID NO: 10319 - RNA, 62 nt, Human
ugcagagcagagcaggcaggggugggggccgggccugcaagagcccgaaaggucgccacccc

SEQ ID NO: 10320 - RNA, 62 nt, Human
ccccaccugcccgaaaaccacugaagccacccuccgcccggacucaacagccgccagcaagc

SEQ ID NO: 10321 - RNA, 58 nt, Human
agcaggaacccugggcagcggguguucugggaaggcuagugacagcagaugucaucca

SEQ ID NO: 10322 - RNA, 62 nt, Human
cgccugcccaggggugagcugccuuuugcuccacagccggcacuaaagacaauucccaaucc

SEQ ID NO: 10323 - RNA, 53 nt, Human
guuaauacuucaggucuguuucccagacccagaaagcuuuacagaaaaucauu

SEQ ID NO: 10324 - RNA, 62 nt, Human
cagcccugcuccugggagcuggaagagcacuuggagauccuaagggaccacacccuuccucc

SEQ ID NO: 10325 - RNA, 60 nt, Human
ccaaacuggacugucuguucauagcgugccugaauaagaaggccucuuagggagccagag

SEQ ID NO: 10326 - RNA, 62 nt, Human
uuuuucuugguuaugaaucuuaauuucgaauauaagaugauagguaagcgcagcuuucuugg

SEQ ID NO: 10327 - RNA, 60 nt, Human
acugcuguuuucuaggccaaaaauggugagcgaucauuuauuucaugauucaaccugaua

SEQ ID NO: 10328 - RNA, 62 nt, Human
uagcaccuggccagcuuauguggcagauggucucaguuacaacuucgcugcuuucccaaacu

SEQ ID NO: 10329 - RNA, 62 nt, Human
cuuccccgagagugaauuuuaacacuguaacaauaaauacuacugcacagcacuuuauggca

SEQ ID NO: 10330 - RNA, 62 nt, Human
cagggagagaggcuggguuggugcucucccuuacucuacucauacugacuuagagccucugg

SEQ ID NO: 10331 - RNA, 59 nt, Human
ugcaggcuuagucuuaagccuccaaaggccuggauuugagcagcuuuagaaaugcaggu

SEQ ID NO: 10332 - RNA, 62 nt, Human
ugcccgcaaaacauugucccuaacuccaccgccuaucccaaaaccuguaagaacuagugaua

SEQ ID NO: 10333 - RNA, 61 nt, Human
uaggaagcggaaggggaaucgcgggaagcuggcccaggucagguccgcaaaggcuucugaa

SEQ ID NO: 10334 - RNA, 62 nt, Human
aagacugaugagacuaggugcuuugcuuccuuucaucagguaucuuucuguggcauuugaga

SEQ ID NO: 10335 - RNA, 62 nt, Human
uucgggccucaguucauugaccagaugacagccacgugaugauuagggaaggacggaugcau

SEQ ID NO: 10336 - RNA, 62 nt, Human
ggauuuuauuuuucacaaaauuuuuauuuaaaaaacucgucaccuuuuggaaaugcccauug

SEQ ID NO: 10337 - RNA, 62 nt, Human
gugggaggagguggggguggacguccauccggugaacagugaaggcguuugugaggucuuuc

SEQ ID NO: 10338 - RNA, 62 nt, Human
uuuuuguuuuuaaaauaaugauuguaaaauguuuuacaaguaauguaaaagcuaguaucauu

SEQ ID NO: 10339 - RNA, 61 nt, Human
ccugucacgagccucugcaggugccugcucaccauggcccagcgccacucuguccuccgac

SEQ ID NO: 10340 - RNA, 62 nt, Human
uagcaaccucgucugugacuccuuagccuggagaacaaucuaccaagaagagaaaguaucug

SEQ ID NO: 10341 - RNA, 62 nt, Human
caucguguggaacuguacaaauauuuauaccaaaaauauagauaagaaaagguggggcuaua

SEQ ID NO: 10342 - RNA, 62 nt, Human
aggcauucuuguuagcuuugucugugcuugaaagccguccgaaagagucgaguccucugagg

SEQ ID NO: 10343 - RNA, 60 nt, Human
accguucgcauggcagccaucaaagaguccuggacgcacaauauccagcgagagaaagag

SEQ ID NO: 10344 - RNA, 62 nt, Human
gcaggcccggacucucccuagcuaagggccaugugcgguggaguguccuaauuuugcagggu

SEQ ID NO: 10345 - RNA, 61 nt, Human
auuuaagacaaguguucuauuuauuucuuguauuguuuggaagaaaaaaugaugauagagu

SEQ ID NO: 10346 - RNA, 62 nt, Human
aguuaagcugagguuuaaacuaaaaaauguuuccuugggucagugguuuugagguccaguag

SEQ ID NO: 10347 - RNA, 62 nt, Human
ggaagaaccaagcggugccagccacgagacgucaccaagaaaacaugcaacucaaacgacgg

SEQ ID NO: 10348 - RNA, 62 nt, Human; identical to SEQ ID NO: 10346

SEQ ID NO: 10349 - RNA, 62 nt, Human; identical to SEQ ID NO: 10347

SEQ ID NO: 10350 - RNA, 62 nt, Human
ccccacuggaccaaaaggggcagcacuggugcccaccauacacacaggugucucaugugacu

SEQ ID NO: 10351 - RNA, 62 nt, Human
uuuuaauaaagcuaaucaauuucuacaaccuugucacauguagcugagucugggaugacuca

SEQ ID NO: 10352 - RNA, 62 nt, Human
ucagggagagcuguggcuucucaugggccucgcaggcguguacuguuaccgugucaaccggc

SEQ ID NO: 10353 - RNA, 62 nt, Human
uucugugagaguugagcucauuuucuaguuggaagaaugugauauuuguuguguugguaguu

SEQ ID NO: 10354 - RNA, 62 nt, Human
cugucccugcguguggccacuccucagcauccuccccacccaccaugguucauuccgacuuu

SEQ ID NO: 10355 - RNA, 62 nt, Human
agugggccccuuucccuuaggauggguaucaauucaacaauauuuauaaggcauuuacugug

SEQ ID NO: 10356 - RNA, 62 nt, Human
uguccuggcgcccggcggcagcugcccagaaacuuccugggagaaagagcccucgggcugcc

SEQ ID NO: 10357 - RNA, 62 nt, Human
uaugaaguuacaaaaucuucagcuucagccaggcaacgcuaagcucugaagaacucccuuug

SEQ ID NO: 10358 - RNA, 62 nt, Human
ugucacuuaaggauggagaucuaacaaugugauacggccauaccagaauaagagcgcaccag

SEQ ID NO: 10359 - RNA, 62 nt, Human
gugaggcuggggucucugcaggggaggucacuggaacagcgagcaagggacuggugccucgc

SEQ ID NO: 10360 - RNA, 62 nt, Human
gaacacugcucuucagcaguucaaguacuuguucucaaaacauuuucuaauugauugguagg

SEQ ID NO: 10361 - RNA, 59 nt, Human
aagugcuggggagauaccaugguuuuccuggagcugguauuuuugggguggagggaacc

SEQ ID NO: 10362 - RNA, 62 nt, Human
ggaacugugccgaguuccuuaaaucucagcugggauccuggaccugggaggccccugugagg

SEQ ID NO: 10363 - RNA, 61 nt, Human
ucuuuguuccuuucagauccuccacuuggcaggcagggccaacagcagcccccgggccagg

SEQ ID NO: 10364 - RNA, 62 nt, Human
agucaucuggaauggucuacaugccaugcggaaguccaccgaaggguuagaacagggugucc

SEQ ID NO: 10365 - RNA, 62 nt, Human
cgcuggcgcauccuggguggaggcaggccccgagcucggggaagggguuuucccuuccucuc

SEQ ID NO: 10366 - RNA, 62 nt, Human
caauaugaaaccagccaacugcuuuuugugcggucuccuauaggaaguaucgcaauuguuuu

SEQ ID NO: 10367 - RNA, 60 nt, Human
aauaauucauagaaaucaugguucucaaguauuuguucaauuagcuuuggggaagaaaug

SEQ ID NO: 10368 - RNA, 62 nt, Human
uucacguguucucgugcgggcgcgugaguggucuucaaacgagggucccgauccccggggcg

SEQ ID NO: 10369 - RNA, 58 nt, Human
gaucucuuggccugguccuugcagcuguggcagcagcaggcuccccagcggcccaggg

SEQ ID NO: 10370 - RNA, 62 nt, Human
cuccuagguucaagcaauucucaugccucagccuuccaaguagcugggauuacaggcacgug

SEQ ID NO: 10371 - RNA, 61 nt, Human
agccccuggagacaccauucacuuuuacugcuuuguagugacucgugcucuccaaccuguc

SEQ ID NO: 10372 - RNA, 62 nt, Human
ccuggcucuccagaaccuucuaucccacagucaggccccagagagggcaggacaagccuugu

SEQ ID NO: 10373 - RNA, 57 nt, Human
guccucugccuuccccgcuuccccaugagcgucugcaaaacacuugccugaauacau

SEQ ID NO: 10374 - RNA, 62 nt, Human
ccaaaacaucagccuaauggcucaugucaguaugagcagaaacauuucaaccaugagauaaa

SEQ ID NO: 10375 - RNA, 62 nt, Human
ucccuuuuaguugaacuaaccuccugaacucccacgacgcuauucaccauccacucggaucu

SEQ ID NO: 10376 - RNA, 62 nt, Human
ccacgcacugcuucgcaggcuccgagcccugcauccuccacagcccccgccuugcucacugu

SEQ ID NO: 10377 - RNA, 58 nt, Human
ccaugaugguuuuuuuuauuuuuuauuuuugagauggaguuucgcucuguugcccagg

SEQ ID NO: 10378 - RNA, 62 nt, Human
ccucucauuccaagggcaggaagaugugacucagccaugacacgugguucuggugggaugca

SEQ ID NO: 10379 - RNA, 59 nt, Human
cacauacuagcagaggaggaagucagagucggccacuaaccagaugcaaauccccacac

SEQ ID NO: 10380 - RNA, 62 nt, Human
cagcgucucugcucacuuagcuggcagugccuguccccagcagccagcaaaggcccggacgg

SEQ ID NO: 10381 - RNA, 59 nt, Human
cagugccccaggucccucggccccacgucccacggcagaagcccugaggacugacuccu

SEQ ID NO: 10382 - RNA, 62 nt, Human
cucaauguguucacuuggacagagcccugccuggccuaacgauuagaggguuagucuccauc

SEQ ID NO: 10383 - RNA, 54 nt, Human
cucuucaacuucguguccuggaucgccuucuucaccacggccagcgucuacgac

SEQ ID NO: 10384 - RNA, 62 nt, Human
gccugugugcgcgggugugggagcacacuuugcaaagccacagcguuucugguuuugggugu

SEQ ID NO: 10385 - RNA, 62 nt, Human; identical to SEQ ID NO: 9264

SEQ ID NO: 10386 - RNA, 62 nt, Human
gucagcaaggugugaggagcacaagccagggugccccgaggaggaggguggguggguccuug

SEQ ID NO: 10387 - RNA, 62 nt, Human
ucucggcucccacagcagagccaggugagggggggccugccaggacuagacagaaguggggc

SEQ ID NO: 10388 - RNA, 62 nt, Human; identical to SEQ ID NO: 9714

SEQ ID NO: 10389 - RNA, 62 nt, Human
agggggcgccugccagggccagacccagguggggcagccugaacccugcuucccccuguggc

SEQ ID NO: 10390 - RNA, 62 nt, Human; identical to SEQ ID NO: 9714

SEQ ID NO: 10391 - RNA, 62 nt, Human; identical to SEQ ID NO: 10389

SEQ ID NO: 10392 - RNA, 62 nt, Human; identical to SEQ ID NO: 9714

SEQ ID NO: 10393 - RNA, 62 nt, Human; identical to SEQ ID NO: 10389

SEQ ID NO: 10394 - RNA, 62 nt, Human; identical to SEQ ID NO: 9714

SEQ ID NO: 10395 - RNA, 62 nt, Human; identical to SEQ ID NO: 10389

SEQ ID NO: 10396 - RNA, 62 nt, Human; identical to SEQ ID NO: 9714

SEQ ID NO: 10397 - RNA, 62 nt, Human; identical to SEQ ID NO: 10389

SEQ ID NO: 10398 - RNA, 62 nt, Human; identical to SEQ ID NO: 9714

SEQ ID NO: 10399 - RNA, 62 nt, Human; identical to SEQ ID NO: 10389

SEQ ID NO: 10400 - RNA, 62 nt, Human; identical to SEQ ID NO: 9714

SEQ ID NO: 10401 - RNA, 62 nt, Human; identical to SEQ ID NO: 10389

SEQ ID NO: 10402 - RNA, 53 nt, Human
guggucaaagcguuccauaguucccuccacgaaagcauucagaaacccuacaa

SEQ ID NO: 10403 - RNA, 62 nt, Human
ucaacucgggaccucccagcgaccacugcagccugcggacgaggccgggacuuggccgagcg

SEQ ID NO: 10404 - RNA, 62 nt, Human
ugggaccuggggaccggccgcugaccagcuccucaccgucgacuuggauggaaccucugcgg

SEQ ID NO: 10405 - RNA, 62 nt, Human
acuggcugaugcucugaauuucuucauauaccccacauuugacuuuggcuuacacuguacaa

SEQ ID NO: 10406 - RNA, 62 nt, Human
gcugcccacucccucagggcccacauguccugccacucgccacucugagcacgaguucaccu

SEQ ID NO: 10407 - RNA, 60 nt, Human
uugucugauggacacaauaugcccuuccgguucuauucaaaccagcaggaucugucggug

SEQ ID NO: 10408 - RNA, 62 nt, Human
ucggguacuuugcuuguugaauaaugcacuuuaaaacaaggaaccguaucaggccagcaugg

SEQ ID NO: 10409 - RNA, 62 nt, Human
ggacaacuuuuaauuugaucagcaagacaucuuggaacucaaucuucuguuggaucacggga

SEQ ID NO: 10410 - RNA, 62 nt, Human
gcugcugggagcagaacagucccucacaccugggcccgggcaggccagcuucgugcuggagg

SEQ ID NO: 10411 - RNA, 62 nt, Human
ggaaugucgcaguuggcaacagcgcagagcugaccccucgcagcgaggagaaucgcugcccc

SEQ ID NO: 10412 - RNA, 62 nt, Human
gggaguuacucuuggaugcaugguuguaaagaaacaaucagaaauaaaggaaaacugagugg

SEQ ID NO: 10413 - RNA, 55 nt, Human
ugccugaaaucccagguacucaggaggcugaggcaggagaaucacuugagcccgg

SEQ ID NO: 10414 - RNA, 62 nt, Human
guggacuggacacccacgugcagcggguuuggcucauuugaaaaugaggguccgugguagcu

SEQ ID NO: 10415 - RNA, 62 nt, Human
gccagacacuucacaucguuuacaugguucuguguaauuuuaaaguuuauguguauaaagcg

SEQ ID NO: 10416 - RNA, 62 nt, Human
uucaugauuaaauucagccuaaacguuucaucaagaacacuacagagucgauacugugaguu

SEQ ID NO: 10417 - RNA, 60 nt, Human
gccucugaccgucaguggugggaaccugggcggcucuggaggcccagggcaggggugggc

SEQ ID NO: 10418 - RNA, 62 nt, Human
ugugccacugcgcucggccucagauuccauauuugaacaccagcugauugagagaaggggaa

SEQ ID NO: 10419 - RNA, 60 nt, Human; identical to SEQ ID NO: 10417

SEQ ID NO: 10420 - RNA, 62 nt, Human
uucaaaauuguucaaaauucaaaagacacagaacgauaaacagugaagucuccuucccuccu

SEQ ID NO: 10421 - RNA, 57 nt, Human
cucagaagcuggcuggggacucuagccucuguguucauaaagacauuaagaagugga

SEQ ID NO: 10422 - RNA, 62 nt, Human
aaacacggccccgacacuuaguguggccccaggccccagcgagccucgcccucccaguuuug

SEQ ID NO: 10423 - RNA, 62 nt, Human
ugugcuggucaagccagggcagucacagcugcuuggggcccacagcacugcugccuggucuc

SEQ ID NO: 10424 - RNA, 62 nt, Human
cugggggaggugauccuugaacuggcucccggggaacauucagagcaugauugguagacaga

SEQ ID NO: 10425 - RNA, 55 nt, Human
ggccucaccucucugugccucgaugucuucaucuacgauacuucugguucccucc

SEQ ID NO: 10426 - RNA, 62 nt, Human
cagggccuuggccacguccugggucucccaccucccaccugaccccagcggcuccggugucc

SEQ ID NO: 10427 - RNA, 60 nt, Human
acgauuccacagaccaggacauuccaugugccucauggcacugccaccuggcccuuugcc

SEQ ID NO: 10428 - RNA, 62 nt, Human; identical to SEQ ID NO: 9512

SEQ ID NO: 10429 - RNA, 62 nt, Human
aucucagcauugcacaaugccucauggaagccuuugaggguaucacacagacacccccaccu

SEQ ID NO: 10430 - RNA, 62 nt, Human
aagcacuacugacucucgcuguauuuaagaugcuggugaagagcuuuugcucuugcauuaga

SEQ ID NO: 10431 - RNA, 62 nt, Human
gcccuccagggcuggggccucgccuggcgggaccccgcagcagccccggccccauccccgcc

SEQ ID NO: 10432 - RNA, 62 nt, Human
ccgcccgguugccgcgcagcggugggaaugucgcaguuggcaacagcgcagagcugaccccu

SEQ ID NO: 10433 - RNA, 62 nt, Human
ggcgguucucgaggugugugccagcuacacguguguucuguauggguccagcugcguuucca

SEQ ID NO: 10434 - RNA, 62 nt, Human
caggggugggggccgggccugcaagagcccgaaaggucgccacccccuagccuguggggugc

SEQ ID NO: 10435 - RNA, 62 nt, Human; identical to SEQ ID NO: 10017

SEQ ID NO: 10436 - RNA, 62 nt, Human
ccuccuuggccaagucugccuuucacccuggggugagcaucaguccuggcucugcuggucca

SEQ ID NO: 10437 - RNA, 60 nt, Human
ugguucuuuuguuuuguuuuuuaacacuugucuccccucauacacaaaaguacaauauga

SEQ ID NO: 10438 - RNA, 62 nt, Human
uauuuuugcuugauagagaaucaaauuugaaacaauuaaccagccaguagauugucugucag

SEQ ID NO: 10439 - RNA, 62 nt, Human
cuuccuagggaaggagacgagcgcuucgccuugauucuccgagaagccuccgagaagugcuu

SEQ ID NO: 10440 - RNA, 62 nt, Human
gccugauuuuuguauuuuuaguagagacaggguuuugccauauugcccgggcuggucuugaa

SEQ ID NO: 10441 - RNA, 62 nt, Human
ugccgggugguccaggcuugcacugaagacgugccacggggaggcuccugcaggaggcucaa

SEQ ID NO: 10442 - RNA, 62 nt, Human; identical to SEQ ID NO: 10440

SEQ ID NO: 10443 - RNA, 62 nt, Human
cagggccggcagggugcuucgggagcccccugcuacggggaaaggcauguguuucuugcugg

SEQ ID NO: 10444 - RNA, 62 nt, Human
aacagcaagaccagauucaucuauuggccaacacugacacaaaaauagcccuccucacacau

SEQ ID NO: 10445 - RNA, 62 nt, Human
uugaugcccccuccccacagugcucaggagacccguggggcacggaacaggagggucuggac

SEQ ID NO: 10446 - RNA, 62 nt, Human; identical to SEQ ID NO: 9592

SEQ ID NO: 10447 - RNA, 62 nt, Human; identical to SEQ ID NO: 9593

SEQ ID NO: 10448 - RNA, 62 nt, Human
aacccgcacugugccuggguguauucuuuauacuguagauaauggagaaauuuucuaucucu

SEQ ID NO: 10449 - RNA, 60 nt, Human
gcccaggugguggagacagagacaggccccugaacgauaagcaccaagagaccccaaggc

SEQ ID NO: 10450 - RNA, 62 nt, Human
gguuagagaagguuugagguagacucugaccgucucauaaaagaguucuacccagcaguugg

SEQ ID NO: 10451 - RNA, 62 nt, Human
ucggaggcuugggaccgccagauggggccucuguuucggagacgggaccgggccgcuagaug

SEQ ID NO: 10452 - RNA, 62 nt, Human
gcagaacaagaggcgcggggccacacccgugaaccaugcagacggccgaagaagucuuaggc

SEQ ID NO: 10453 - RNA, 62 nt, Human
uauucccaguaaaguggguugaggugagggcugugguccugaaagggacgccuuugacaucg

SEQ ID NO: 10454 - RNA, 62 nt, Human
acugcugggacuggccagguuucugcccacauuggacccacaugaggacaugauggagcgca

SEQ ID NO: 10455 - RNA, 57 nt, Human
ggcacccccuguuguaggcacuggcuagggaggggcaggccuccuuccugccccucg

SEQ ID NO: 10456 - RNA, 62 nt, Human
gcguguguguauauggacuuugucccuuaaggucgauauaaagaauccucgcagaaucacag

SEQ ID NO: 10457 - RNA, 59 nt, Human
ggcagggagauuucgguuuugagguuucuaaauacauuaaaguuauuucuuaagaaccu

SEQ ID NO: 10458 - RNA, 62 nt, Human
aggaggccucuggggaagggguucccucccuccugaagaugaacacacaauacacggaagag

SEQ ID NO: 10459 - RNA, 60 nt, Human
gaggccgagccugaauccuugccugugucugacgggaccacuacuaaaaaccuaaaaaua

SEQ ID NO: 10460 - RNA, 62 nt, Human; identical to SEQ ID NO: 9730

SEQ ID NO: 10461 - RNA, 62 nt, Human; identical to SEQ ID NO: 9731

SEQ ID NO: 10462 - RNA, 62 nt, Human
ugguggcuuugugaagggugaaaaucagugaugggacauuuacuaaguauuucuuuuuuuuu

SEQ ID NO: 10463 - RNA, 61 nt, Human
ucugugugguuguagcaaggacucagccucauguagcacgaauaggggugugguucauggc

SEQ ID NO: 10464 - RNA, 62 nt, Human
cuaagaccgagaaauuuaaagaaucggacagauggacgcagagaaccagagggcaauguggg

SEQ ID NO: 10465 - RNA, 53 nt, Human
cacaccacguccuggucuuuguuugaggccugacgugggcaucauuuuaacag

SEQ ID NO: 10466 - RNA, 62 nt, Human
guggccggcaugccccgaucuuucacacacuggugacccugagagaggagggaggagggaac

SEQ ID NO: 10467 - RNA, 60 nt, Human
auuuuuuugccaauggugccaaguaaugugaaugcuaauacugcuuaagaaaauuaaguu

SEQ ID NO: 10468 - RNA, 62 nt, Human; identical to SEQ ID NO: 9333

SEQ ID NO: 10469 - RNA, 62 nt, Human; identical to SEQ ID NO: 10441

SEQ ID NO: 10470 - RNA, 62 nt, Human
accaguggaaauugauuggaauagaaacuuaaaggaaauggaacccuaacuauucucccauc

SEQ ID NO: 10471 - RNA, 60 nt, Human
aaauauuugaaagggauuauauuaauugcuaaauauuuuauucacaaaggucaauaacau

SEQ ID NO: 10472 - RNA, 62 nt, Human
ugcucaggcccuccccucccaugcaggccgaugacaacugcagcccucucugcacucccuag

SEQ ID NO: 10473 - RNA, 60 nt, Human
gaggacacugaguaauuuacaaacacaacugcauucauaaaugggaauagaacgugaaag

SEQ ID NO: 10474 - RNA, 62 nt, Human
ccucagugagcugcagguaucucaccuggcagccguccaguacugcuggcuuccucuggagg

SEQ ID NO: 10475 - RNA, 62 nt, Human
acauauauucugugagauaacugugccugcuaccaaguguuaauccugggaucguauuuuua

SEQ ID NO: 10476 - RNA, 62 nt, Human
uagguuugucauuuugcaaguuacauaaacauuuaucaaugaagucauccuuuagacuugua

SEQ ID NO: 10477 - RNA, 61 nt, Human
guuucaccagcguuggguuugcucauguaauguggucaccauacucaaauggugucauggc

SEQ ID NO: 10478 - RNA, 62 nt, Human; identical to SEQ ID NO: 9512

SEQ ID NO: 10479 - RNA, 61 nt, Human
ugaggguggcaugcccaccuccaguccagcccagggcgguagcagcaaagcguggcaucgc

SEQ ID NO: 10480 - RNA, 62 nt, Human; identical to SEQ ID NO: 9512

SEQ ID NO: 10481 - RNA, 57 nt, Human
ugacgcccccgugcagcuugggccggagggcaagggaugccaguaagucugcaggug

SEQ ID NO: 10482 - RNA, 62 nt, Human
gauauuuuuaaaacaggguacaacccccugcugcacacgcuagcauaucuggaaccuacuau

SEQ ID NO: 10483 - RNA, 62 nt, Human
ccuuccccuggacuguccucugacccuuuggcucauccuagauugcaguguguccuguggac

SEQ ID NO: 10484 - RNA, 62 nt, Human; identical to SEQ ID NO: 9408

SEQ ID NO: 10485 - RNA, 59 nt, Human
cagguggcuggagccagcagccaggaccagggucguugacagcagguucugcagcaucc

SEQ ID NO: 10486 - RNA, 62 nt, Human
aauuuuggauuuucauuuucauguuuuauuuuguaaauauuaucugauguuuggagcuugag

SEQ ID NO: 10487 - RNA, 62 nt, Human
gagggaagugcacgcgaaacagacacagcggcuucaaauagaugccgccccugcccgcgcuu

SEQ ID NO: 10488 - RNA, 62 nt, Human
aacuauggcuaugaccaaagcuucuauuuugccaaaaaguuaaauaccgauaaaauggccuu

SEQ ID NO: 10489 - RNA, 62 nt, Human
aaccucuucaagacuuuugacuuagaaccugcuauauuaucaagcuuaccuacuguuaucuc

SEQ ID NO: 10490 - RNA, 62 nt, Human
gaagcaggcagagcucagaggaucuuggcaucacccaccaaaguuagcugaaagcagggcac

SEQ ID NO: 10491 - RNA, 62 nt, Human
cguggugcguggccuaauggccgccaugggcaacacggaccacagcaacagccagcggcugg

SEQ ID NO: 10492 - RNA, 62 nt, Human
guaggaaggcagaauguaacuguucuguuuguuuaacgauuaaguccaaaucuccaagugcg

SEQ ID NO: 10493 - RNA, 59 nt, Human
uugucugauggacacaauaugcccuuccgguucuauucaaaccagcaggaucugucggu

SEQ ID NO: 10494 - RNA, 62 nt, Human; identical to SEQ ID NO: 9547

SEQ ID NO: 10495 - RNA, 60 nt, Human
ccagauuaaucauuucaaagacauccauuuuagaucacaagcaggaagucgauagucuca

SEQ ID NO: 10496 - RNA, 62 nt, Human
aaaacauugucccuaacuccaccgccuaucccaaaaccuguaagaacuagugauaaucccac

SEQ ID NO: 10497 - RNA, 56 nt, Human
uuaagguuuuuauagcauaaugguaguacgaacauaaaaaugcauuuauuccguuc

SEQ ID NO: 10498 - RNA, 52 nt, Human
agccuggcgggcggagcuaagggccuccaccagcauccgagcaggaucaagg

SEQ ID NO: 10499 - RNA, 62 nt, Human
uggcuuguguguguccaucucgccuguuggcucagugcuucaucccauuugcagagccucag

SEQ ID NO: 10500 - RNA, 62 nt, Human; identical to SEQ ID NO: 9609

SEQ ID NO: 10501 - RNA, 62 nt, Human
gaaugagauuuauccaauguugggucaagaacauugcuucgacauggaaauuaacauggaac

SEQ ID NO: 10502 - RNA, 62 nt, Human
ugaacuggggccggguggggaagagugagaugggauaacauagccccugcuuggaggcccuu

SEQ ID NO: 10503 - RNA, 60 nt, Human
ccaaggcccccaggagcugggacucugcuacacccagugaaaugcugugucccuucuccc

SEQ ID NO: 10504 - RNA, 60 nt, Human; identical to SEQ ID NO: 9971

SEQ ID NO: 10505 - RNA, 62 nt, Human
gggccaaaugugccaugggacacuuagugccaugccugcgcagaccuguggaauaaacagca

SEQ ID NO: 10506 - RNA, 62 nt, Human
cagccaccaugugaagagucuuuguuccuuucagauccuccacuuggcaggcagggccaaca

SEQ ID NO: 10507 - RNA, 62 nt, Human
uccagagaaguguucagaugccccccuugggcuccuuucuaauuuuaaucagcucuuuaaau

SEQ ID NO: 10508 - RNA, 62 nt, Human
uuguauuuguacuaauucugauucuuuugcuguauagccuuagaugugcaaugcagacacua

SEQ ID NO: 10509 - RNA, 62 nt, Human
aguggcccuucacacaacuuuugaaucucuaaaaauccauaaaauccuuaaagaacuguaag

SEQ ID NO: 10510 - RNA, 62 nt, Human
auuaaguuacuuuugcaaaacagauaaucauaagaugaaucaguauguagcuuaacaccauc

SEQ ID NO: 10511 - RNA, 61 nt, Human
ucuguucuucaggaaccgacuccucuccaguugcaacaccagggagaaaggggccuccaca

SEQ ID NO: 10512 - RNA, 62 nt, Human
ccuggaucgccuucuucaccacggccagcgucuacgacggcaaguaccugccugcggccaac

SEQ ID NO: 10513 - RNA, 62 nt, Human
cacgauccuugacgggcacagccagaagcugcaccuggccgagaacgccgagccugaggagc

SEQ ID NO: 10514 - RNA, 62 nt, Human
uggacgugaccguaucccucugccacaccccaggcccugcgaggggcuaucgagaggagcuc

SEQ ID NO: 10515 - RNA, 62 nt, Human
uuaggaucuguacauagagaaauauuuaaauuuuuagaagcaaaacuuauacaacauuaaaa

SEQ ID NO: 10516 - RNA, 62 nt, Human
aaaccaccuuuauguauuuucuuaaagcacgccuuuaaauaagcaaaaacuuuaaaaggcag

SEQ ID NO: 10517 - RNA, 62 nt, Human
uuuaaaaaguuuaaguaccaaagguagucuagucuagaacgauaaguuaauacguguuggcu

SEQ ID NO: 10518 - RNA, 62 nt, Human
gguggagugcaguggugugaucucggcucacugcaaccuccaccuucagggugucaggccuc

SEQ ID NO: 10519 - RNA, 62 nt, Human
aaaaaaagaaagaaagaaagaaagaaagaaauccuacuacgagcgaucacaccaucuggccu

SEQ ID NO: 10520 - RNA, 62 nt, Human
ccucuggcuuggagagcauuccaagcccccaccccaccccuagaacugccauucccaagacc

SEQ ID NO: 10521 - RNA, 62 nt, Human; identical to SEQ ID NO: 10167

SEQ ID NO: 10522 - RNA, 62 nt, Human
aggaugagucuuggaguugcgggcagccuggagacucguggacuuaccgccuggaggcaggc

SEQ ID NO: 10523 - RNA, 62 nt, Human
ugccucgaagagucagucugcccugccuuuuccuuucgggcaccaccagccauccccgagug

SEQ ID NO: 10524 - RNA, 62 nt, Human
ugugggagaagaaugaaauaagacgugaaguguaggaaaucaugaaaagaacaauuuugcaa

SEQ ID NO: 10525 - RNA, 62 nt, Human
cgcagagccggggcccagcgaaucacgcagagaaaucuuacagaaaacaggggugggaaucu

SEQ ID NO: 10526 - RNA, 62 nt, Human
gugaugggccagccugccccaaggcucuuuacugaugucagaaucauuguuugcaccugcug

SEQ ID NO: 10527 - RNA, 62 nt, Human
cccagagcgagcaaacgcugagaccugaaaggacauggaugagaagaggagcccgcuuccug

SEQ ID NO: 10528 - RNA, 62 nt, Human
ucugcagaguuguugcuagggagacuugugucaucauccacaaccuuguuucucacuuccug

SEQ ID NO: 10529 - RNA, 62 nt, Human
ugccuuucugccucugucgauuuuaggguauggauauuaggagccauaacuuguaaucuugu

SEQ ID NO: 10530 - RNA, 62 nt, Human
ccucggcuccaugugccagaggcuccgguccaugcaguacaauggcagcuacuucgacagag

SEQ ID NO: 10531 - RNA, 62 nt, Human
aaacgaauccauagcugacaaauucacucagugcccaauauauugugauuauuuucguugau

SEQ ID NO: 10532 - RNA, 62 nt, Human
aggaaaggaacaaauuuucaaagacuugggggagugaaggcagagccuggugcagauggacg

SEQ ID NO: 10533 - RNA, 62 nt, Human
gcggcagaggcgcacgggaagcccggggcccaggcucaugcaacacgacgcucaccgcggcu

SEQ ID NO: 10534 - RNA, 62 nt, Human
aacucagcaagaagggacuguuucuaggugggcugggcgcgagcagggacugucccgagcgg

SEQ ID NO: 10535 - RNA, 61 nt, Human
ccaugcuccgugugucugugucugcauguccacacgucugaugcaccuguguacguguguc

SEQ ID NO: 10536 - RNA, 62 nt, Human
cuuucaguaaggaagggucuuugggguuuucugugcccaugacuugggggcugcacccccac

SEQ ID NO: 10537 - RNA, 61 nt, Human
gggcucauccaggccgcccagcagcugcugugugaugagcaggccccacagaggcagaggc

SEQ ID NO: 10538 - RNA, 62 nt, Human
gaaugccuaccugaccaccaucaccaagcagaucacgcccuacguccgcuccauugccaagg

SEQ ID NO: 10539 - RNA, 62 nt, Human
gauuaaaaacuuucucuuccacggacuuuaagcccgguaggaaagagagaggaggaggggga

SEQ ID NO: 10540 - RNA, 62 nt, Human
ggcaucggcagcugaacccugcuccguuggucagcguuacuaucaucucggaucauauggag

SEQ ID NO: 10541 - RNA, 60 nt, Human
cuuuauaauuucuugaacaggcaaaugaaagcuuauuauagaaugcauguauuuucuuuu

SEQ ID NO: 10542 - RNA, 62 nt, Human
gguugguauagaauggugggaauucaaauuuuucuaaacucaugguaaguauauuguaaaau

SEQ ID NO: 10543 - RNA, 62 nt, Human; identical to SEQ ID NO: 9391

SEQ ID NO: 10544 - RNA, 62 nt, Human
agcgucagacccaggacuguucagggaggagccccggucagacucccacgugugaagaccgg

SEQ ID NO: 10545 - RNA, 62 nt, Human
gcccuugaugugccauuucugaauaauagucacugccgccgagucuaggauguccuguucua

SEQ ID NO: 10546 - RNA, 62 nt, Human
cuauucucccaucaaaucauauauguugaccugucugaauuauaaaccagccugaccuuucc

SEQ ID NO: 10547 - RNA, 54 nt, Human
gcgucgggggaaccugccgcaaggagcagagacagcacagccccccgggcccag

SEQ ID NO: 10548 - RNA, 62 nt, Human
ucucuuccgauagagucgcuauuucugguuaauauacauauauaaauauauaaauacaaaca

SEQ ID NO: 10549 - RNA, 62 nt, Human
gggaauaccagcgcuucccccaucuggugaugcuugagugcacagagaccaacucccugggc

SEQ ID NO: 10550 - RNA, 62 nt, Human
uggggagccggugaaugauccgugcaggaguggggcuuagcagccacauuucuaggagaugc

SEQ ID NO: 10551 - RNA, 62 nt, Human
ggcaccuggacgcugaugguggccaggaugcucagcuggccaggagggcagcaccugcuggg

SEQ ID NO: 10552 - RNA, 62 nt, Human
cacccuaggccaggcgcagaggccuggcaggcaggcuuggcaugguuggccggggcgggacg

SEQ ID NO: 10553 - RNA, 62 nt, Human; identical to SEQ ID NO: 10551

SEQ ID NO: 10554 - RNA, 62 nt, Human
ugcaugccaggcugggcacggcuccgagggcggccagggacagacgcuugcgccgagaccgc

SEQ ID NO: 10555 - RNA, 62 nt, Human
gcacugggaccccacacagcaauacgaguccaacuuaauaaacacauuucugggguuccuca

SEQ ID NO: 10556 - RNA, 62 nt, Human
cauuuuaaguucuccgugauuaaaaaccagcccaaaacaucagccuaauggcucaugucagu

SEQ ID NO: 10557 - RNA, 62 nt, Human
uguugauuucucaaaggucuuccaaaacucaacagagccagaaguagccgcccgcucagcgg

SEQ ID NO: 10558 - RNA, 62 nt, Human
gcuccuaacucugaacaacccacggcagcuucuagccccgcaucuggaaaaaggccccuuuc

SEQ ID NO: 10559 - RNA, 62 nt, Human
agaggcagagggcacaggaaagaagccgggccaagcucggaauuaaugugccacaaguguug

SEQ ID NO: 10560 - RNA, 62 nt, Human
gccaggaguaggauuucauuauaaaauuaauagcuaaucuuauucuaucuccugaagauuua

SEQ ID NO: 10561 - RNA, 62 nt, Human
ugcacacgagugcggcuggacgugccgacacgcggugauguacccaugcuccgugugucugu

SEQ ID NO: 10562 - RNA, 62 nt, Human
gggggaaaacaguaguuccgaaaaaaaaaugugcuccgacuauugaauggaaagacacccaa

SEQ ID NO: 10563 - RNA, 60 nt, Human
agccaaggugggcugagcccuggcaggaugacccugcgaaggggcccugguccuuccagg

SEQ ID NO: 10564 - RNA, 62 nt, Human
ggaucugucggugcuuagagauggcugccuggacuggaaucaaaucuaauuucagggaaaug

SEQ ID NO: 10565 - RNA, 61 nt, Human
gcuacuccuuccuguagagcagaaauuguauuuugcacgaacaugcaguuauugaagauua

SEQ ID NO: 10566 - RNA, 62 nt, Human
gcuggugugugaauaucuauaaauaaguauauaugguguauauuauauguguauaaauaaag

SEQ ID NO: 10567 - RNA, 56 nt, Human
uacguauuugaaaaauaaaauugcaauucgagauaagugcuugagcacucuacuua

SEQ ID NO: 10568 - RNA, 62 nt, Human
gcugcuccuggucaguggaggucagccggguaucaaaagccaugaaacugugucucuguagc

SEQ ID NO: 10569 - RNA, 62 nt, Human
aacauccugugccaaagguauuggucauuuagaaugucgguagccauccaucagugcuuuua

SEQ ID NO: 10570 - RNA, 62 nt, Human
cauguuucugauaauuaugcaagcaacaauucuguagccucaaguaagaccaccugugaacu

SEQ ID NO: 10571 - RNA, 61 nt, Human
ucccaacaugguccuagcacugcacacucaguucugcucuaagaagcugcaauaaaguuuu

SEQ ID NO: 10572 - RNA, 62 nt, Human
uuccauguugcauuucaucuguguacugaaccacuagccuaauagaccagcacggucaacua

SEQ ID NO: 10573 - RNA, 62 nt, Human
ggugagugccuucuguacagucgacugcaaaugaaacgcagaggaugggugcccagaagcac

SEQ ID NO: 10574 - RNA, 62 nt, Human
gguccagcuagcagccacugggaaucagaggaauggggcagagcugggcauucaggaccuug

SEQ ID NO: 10575 - RNA, 61 nt, Human
auaaaggagaaucuacgcugguccucaggacguguuaaagagaucugggccucauguagcu

SEQ ID NO: 10576 - RNA, 62 nt, Human
ccguggggccgucagagaaaccuuuuuaaaaaauggagaugaauguuacagaauuggacaac

SEQ ID NO: 10577 - RNA, 62 nt, Human
ggaggaggacggauugauuccacauuccacuuccuagaucuaguuuagaaaacauguucccc

SEQ ID NO: 10578 - RNA, 62 nt, Human; identical to SEQ ID NO: 9838

SEQ ID NO: 10579 - RNA, 62 nt, Human
uugcauucuuccuagaagaguuccucugcuccuuccauuccauuuuuguguuuguuuuguuc

SEQ ID NO: 10580 - RNA, 62 nt, Human
ugcuuucugcuuacugacuuaggcaauacaccaagggcgagauuuuauaugcacauuucugg

SEQ ID NO: 10581 - RNA, 59 nt, Human
uacuaagcugagagaugucauugcugcaggcaggacguauaggcacauguagguuugaa

SEQ ID NO: 10582 - RNA, 62 nt, Human; identical to SEQ ID NO: 10580

SEQ ID NO: 10583 - RNA, 59 nt, Human; identical to SEQ ID NO: 10581

SEQ ID NO: 10584 - RNA, 62 nt, Human
ccucucuggcuuccaugcuccgccuguaaaaugggggcgcuauugcuucagcugcugaaggg

SEQ ID NO: 10585 - RNA, 60 nt, Human
cccuuuguugcccaggcuggucuccaacuccugggcucaagcaauccuccugccucggcu

SEQ ID NO: 10586 - RNA, 62 nt, Human
aagcgucagcgggcgcugcugggagcagaacagucccucacaccugggcccgggcaggccag

SEQ ID NO: 10587 - RNA, 62 nt, Human
gaauaauagucacugccgccgagucuaggauguccuguucuaacucagcccugccucggaug

SEQ ID NO: 10588 - RNA, 62 nt, Human
ugccccacgguguccccgccgggaagcagccccggcuccugaaucacccucgcuccgucagg

SEQ ID NO: 10589 - RNA, 62 nt, Human; identical to SEQ ID NO: 9408

SEQ ID NO: 10590 - RNA, 62 nt, Human; identical to SEQ ID NO: 10588

SEQ ID NO: 10591 - RNA, 62 nt, Human; identical to SEQ ID NO: 9408

SEQ ID NO: 10592 - RNA, 62 nt, Human
aucauuguaagacaauuuauuaauuugagaaagucaccuugacaguucuuugcacacaaguu

SEQ ID NO: 10593 - RNA, 62 nt, Human
ccugagcauccaggcccagagcuggaugcauccucggcccaagaucacaggaaggcagauug

SEQ ID NO: 10594 - RNA, 62 nt, Human; identical to SEQ ID NO: 9314

SEQ ID NO: 10595 - RNA, 59 nt, Human
caggcggggucuuuguucucggcucccacagcagagccaggugagggggggccugccag

SEQ ID NO: 10596 - RNA, 62 nt, Human
ggggccgguggaaugacuugagcagcucugggaguggggaaaaaagacgacuaauuuccaaa

SEQ ID NO: 10597 - RNA, 61 nt, Human
ucugucccaggcgggauggggcacagugcaggacacagccauguacaccaagaagagagua

SEQ ID NO: 10598 - RNA, 62 nt, Human
agacuuuguugccugcugcuuauugucuaauuuacagggauauuuaauuuugucaggucuau

SEQ ID NO: 10599 - RNA, 62 nt, Human
gacacuuccucugaaugcuguaucucauggcaccugguccaacuagaaauggucaaggaauu

SEQ ID NO: 10600 - RNA, 62 nt, Human
auagagcuaugugaguacuaaucacauugaauaauaguuauaaaauuauuguauagacaucu

SEQ ID NO: 10601 - RNA, 62 nt, Human
gcgccuggccaauguuguuguuguuuuuaagacagaauuucacucuuuguugcccaggcugg

SEQ ID NO: 10602 - RNA, 62 nt, Human; identical to SEQ ID NO: 9757

SEQ ID NO: 10603 - RNA, 62 nt, Human
aaauauggaucaucacagauccaaacagaaaaaugggggcgauguccccacauggagggaac

SEQ ID NO: 10604 - RNA, 62 nt, Human
accugugccaauaauaccauuaugugccauguacugacccgaaaggcucggccgcagagccg

SEQ ID NO: 10605 - RNA, 62 nt, Human
ugcuagaugcaaaagucauauuuuagcaauuucuucagacgauauacagaaccccagcgcuc

SEQ ID NO: 10606 - RNA, 62 nt, Human
aaauuuaauccaaacugaaauuuuguuucaacugaauuuguaauuaacucugaauuuguuuu

SEQ ID NO: 10607 - RNA, 62 nt, Human
gagaagaugucaaauggagagccucaaacuguggccgacugacaugcgugcaucuuuugggg

SEQ ID NO: 10608 - RNA, 62 nt, Human
ugcauuucacgagccacagguggggcucauccaggccgcccagcagcugcugugugaugagc

SEQ ID NO: 10609 - RNA, 62 nt, Human
agcccgcuuccuguacauauauuuaagugacaaacacggucaaaagcuuaagggacagguuu

SEQ ID NO: 10610 - RNA, 62 nt, Human
cauuccuucaugucuuuauuuaguuguuuauuuauuuaguuauuuaucuuauuuauugaggg

SEQ ID NO: 10611 - RNA, 62 nt, Human
guagucuacuuaaaaauguuucugggaaauucacuagaaacauuaaccaauaggauuuuggu

SEQ ID NO: 10612 - RNA, 62 nt, Human
ccccaggcucuuagagacuaaggggcagcuccugaccaaagacgauacagcuuggcacuuua

SEQ ID NO: 10613 - RNA, 62 nt, Human
uucaagucaucuuuugcaggaagugagccaagauuuguucuagacucccauuuugcaaaagg

SEQ ID NO: 10614 - RNA, 62 nt, Human
ccuuggcccacccagguccagagcauccacuucaaguuaccacccauucugucuuccagaca

SEQ ID NO: 10615 - RNA, 62 nt, Human
uguugguuuuccuuuugcagcacacugggcagucucccuauaaaacaaaaaccccaccuucu

SEQ ID NO: 10616 - RNA, 62 nt, Human
cucuaaagccgcccgccagcccaggccgcugcucugcaccgagcuggugggcuuggguuuug

SEQ ID NO: 10617 - RNA, 56 nt, Human
cuguggguggccuggguguguccuguggacggcggagacuguugauuuggauguug

SEQ ID NO: 10618 - RNA, 62 nt, Human
cucuguccagggucuucccgucccaucugucugcugcgccuacugggugggagcccugguuu

SEQ ID NO: 10619 - RNA, 62 nt, Human
uacagaaaccacagaaauauucccuuagaauaaaauaguauauuuguauuugaugggugagu

SEQ ID NO: 10620 - RNA, 62 nt, Human
ccaugcuguugcuugcgucucgaaucuucgguucucgaggaaguguugacagugugaugcua

SEQ ID NO: 10621 - RNA, 62 nt, Human; identical to SEQ ID NO: 9390

SEQ ID NO: 10622 - RNA, 62 nt, Human
ugauugugauuagagaaccuuggacauuuugcugcuaaagaaucuuuuuuccccucuccccc

SEQ ID NO: 10623 - RNA, 62 nt, Human
ggacauucggacggauggagcccucagcgugucuuuucagcaggagcagaaccgaugagagc

SEQ ID NO: 10624 - RNA, 62 nt, Human
auucagugcuguggccugggcaagauaacgcacuucuaacuagaaaucugccaauuuuuuaa

SEQ ID NO: 10625 - RNA, 56 nt, Human
ccccaaggcagaaaccaagaacugucugcaggcaaauaagcacccagcacccaucc

SEQ ID NO: 10626 - RNA, 62 nt, Human; identical to SEQ ID NO: 10624

SEQ ID NO: 10627 - RNA, 56 nt, Human; identical to SEQ ID NO: 10625

SEQ ID NO: 10628 - RNA, 62 nt, Human
gcuccucccugugucuuugcuguucuucagacuccauuuauagagaaugagggcugauaaca

SEQ ID NO: 10629 - RNA, 62 nt, Human
agucacugccucuguugaaugccugccaucaggguggauauauuucaagcuuucuucugguc

SEQ ID NO: 10630 - RNA, 62 nt, Human
uggucccucgaugugcgucuggguccugaucuccuccucuuauaaggacacaaaucauguug

SEQ ID NO: 10631 - RNA, 62 nt, Human
gaggagaguagaaaccacagcucuuaguaguaauggcauacagucuagaggaccauucaugc

SEQ ID NO: 10632 - RNA, 62 nt, Human
ugugccaguaaucccagcuacuugggaggcugaggcgcgagaaucgcuugaacccuggagau

SEQ ID NO: 10633 - RNA, 62 nt, Human
aggcucaugugacuaagaggaucuguccacauuuggggccuauccuuacuuguuugaaaaaa

SEQ ID NO: 10634 - RNA, 62 nt, Human
cuucaugcugccccuggcgccuagaacccuugccccuccucauagaccaagucccggggguc

SEQ ID NO: 10635 - RNA, 58 nt, Human
gcaaaacugugucacaguuucaggcuuuuaugaggaaagcguuucuguguagaaacug

SEQ ID NO: 10636 - RNA, 62 nt, Human
cccaccuucucccacugaagcaccaaggggcuugaaccguaauuuggcuaaucagaggcauu

SEQ ID NO: 10637 - RNA, 62 nt, Human
augaauuuuuuuuuaauccaauauccguugauuugauugugauuagagaaccuuggacauuu

SEQ ID NO: 10638 - RNA, 62 nt, Human
uuggacagucucccugauggacccucagucuucucaugaauaaauuccuucaacgccugugu

SEQ ID NO: 10639 - RNA, 60 nt, Human
aaagaugggguuccuguagauuuuuuggugcuaagggauacuuugucauuaugaugaagu

SEQ ID NO: 10640 - RNA, 62 nt, Human
gagcccuggugucagagucguaauuuaaagcguguguguauauggacuuugucccuuaaggu

SEQ ID NO: 10641 - RNA, 58 nt, Human
uugacuguuuugggcuucauucggcuuagaguucacgaaugccggcuuucccaccuga

SEQ ID NO: 10642 - RNA, 62 nt, Human
guggugggucucaucuuucccaucucgccugagagcggcugagggcugccucacugcaaauc

SEQ ID NO: 10643 - RNA, 62 nt, Human
ccugaagguauucagauacagcuggguauaaaacaacgggcacagaguguaauuucuuaaca

SEQ ID NO: 10644 - RNA, 62 nt, Human
cuuccuaccccugagugggacaagaagggcccugagugcccaggagugccccacguucugag

SEQ ID NO: 10645 - RNA, 60 nt, Human
aggggccgcuuaccccuggccguccgcuggcugaacugaacgcauucccucucuccgcaa

SEQ ID NO: 10646 - RNA, 62 nt, Human; identical to SEQ ID NO: 9234

SEQ ID NO: 10647 - RNA, 62 nt, Human; identical to SEQ ID NO: 9235

SEQ ID NO: 10648 - RNA, 62 nt, Human
guaggcccucccauuggcuuuggccaggccagacacuucacaucguuuacaugguucugugu

SEQ ID NO: 10649 - RNA, 62 nt, Human
uguugcagcuguugcagucccccagauaccuauuauuuuacacaauuugaccuauaggagga

SEQ ID NO: 10650 - RNA, 62 nt, Human
uggcagugccuguccccagcagccagcaaaggcccggacggaaagcccagucgggggucugu

SEQ ID NO: 10651 - RNA, 62 nt, Human
guccggaacaagacgccucggccacggcucccccucggccuauuacacgcgugcgcagccag

SEQ ID NO: 10652 - RNA, 62 nt, Human
ugggguucuaaugccaguuuccuaauuccaucucacuggagauguuuaaaguuggccucuau

SEQ ID NO: 10653 - RNA, 57 nt, Human
ccugggggucccagggugguggggguggcaggugguaccacagcucugagagcagau

SEQ ID NO: 10654 - RNA, 62 nt, Human
uggaaacaauggaaacuuacagaugccugccugggaugaugaggcacauucagaacaaaugc

SEQ ID NO: 10655 - RNA, 61 nt, Human
uuuuuaaaaaggagcuucaaugauuuguaacugaaauaucagguucuagaagaaacuggcg

SEQ ID NO: 10656 - RNA, 62 nt, Human
cugcagauugccgugaacucuaucaauagucucuuuuccgcaggcaaaguggcauuuucuaa

SEQ ID NO: 10657 - RNA, 62 nt, Human
cuuucuggagaggagggaugcugccugagucacccaugaagacaggacagugcuucagccug

SEQ ID NO: 10658 - RNA, 62 nt, Human; identical to SEQ ID NO: 10656

SEQ ID NO: 10659 - RNA, 62 nt, Human
gaggauaccuaucaaaaugccaaagcugcagggacacgaagacgguugaaaauucaaccugu

SEQ ID NO: 10660 - RNA, 62 nt, Human
ucccccaccagguggcagcacagccccacugugucuuccgcagucuguccugggcuugggug

SEQ ID NO: 10661 - RNA, 62 nt, Human
aggggccauggucucacugccaucacuuauuagccaugagaauuugguuguaguuuucaggu

SEQ ID NO: 10662 - RNA, 62 nt, Human
ccaaauccugagauauugcugauuugcuauggcaggucgucaagagaacugugucauuccaa

SEQ ID NO: 10663 - RNA, 60 nt, Human
ccccgcccccaagugugacuccagauggccaggguguacaccaccuuucggccacuauug

SEQ ID NO: 10664 - RNA, 62 nt, Human
ccccuucgccucccuccccuccgccagagcugccuguggccagacacacgguggagggaagu

SEQ ID NO: 10665 - RNA, 61 nt, Human
uuuuuuuguuuuugguuuuuuaugguuuuuuaaggaaaauacuuuucuccuuugaaguuuu

SEQ ID NO: 10666 - RNA, 62 nt, Human
uuggaagggguuaaggugaggacagggaaugggagcucgugaauugacuauuugggaguggc

SEQ ID NO: 10667 - RNA, 62 nt, Human
acccuuaccgguggcucuuccugccugggacccucccgcagagucccacuagccagcggccu

SEQ ID NO: 10668 - RNA, 62 nt, Human
ccaggggcugugggggcggggcgccgggucgggccgagugcagcaccagguucuugacacag

SEQ ID NO: 10669 - RNA, 62 nt, Human
cccaaccaugggcuggguuuugugcuuacuguauguuggcgacuugguagggcaggagacgc

SEQ ID NO: 10670 - RNA, 62 nt, Human
uggugcugcuguccccagccaggcccuguuccucacugcggagugcuagcaagggcgcuagg

SEQ ID NO: 10671 - RNA, 61 nt, Human
cacugagggccucgccuggcugcagccugcgccaccgcccagagacccaagcugccucccc

SEQ ID NO: 10672 - RNA, 62 nt, Human
uugcacagugccuuuacagauuuacguaugggcugaugaagaggccuucuuaaguuccagag

SEQ ID NO: 10673 - RNA, 60 nt, Human
aauaccgauaaaauggccuuaaguguauuccugacaguuaaauucagaaacgugccaaau

SEQ ID NO: 10674 - RNA, 62 nt, Human
ccucugcugagaauccccacuugguguagggggagaggggaaaggggucuggcccaucgagg

SEQ ID NO: 10675 - RNA, 62 nt, Human
ugaacuauuuaaacccacuggguccugccacauccuucucaaggugguagacugaguggggu

SEQ ID NO: 10676 - RNA, 62 nt, Human
guaaaguaauauaaaguuauauuggaucuucuauugcacuaauucuagaugucuaauucagg

SEQ ID NO: 10677 - RNA, 62 nt, Human
gaauacugucuacaugcuuucucauucaagaauucgucaucacgcaucacaggccgcgucuu

SEQ ID NO: 10678 - RNA, 62 nt, Human; identical to SEQ ID NO: 9851

SEQ ID NO: 10679 - RNA, 58 nt, Human
uuucuuuuccauuguuucuggauauuuguauuauccaaaugugcuuauuucuuugccu

SEQ ID NO: 10680 - RNA, 62 nt, Human
cugcauguuuuuguuuuguuuuucgggguuuuuuuuaauugaagcccuaaaccaggaauuau

SEQ ID NO: 10681 - RNA, 62 nt, Human
cagaagccucaggguaauguguugguuagcacguaacuacuaggauuggggcccuagggauu

SEQ ID NO: 10682 - RNA, 62 nt, Human
cagugcuguggccugggcaagauaacgcacuucuaacuagaaaucugccaauuuuuuaaaaa

SEQ ID NO: 10683 - RNA, 61 nt, Human
aauacguuagaaaaugacagaugguagagacuuccauagaauuaagaggguucucauggag

SEQ ID NO: 10684 - RNA, 62 nt, Human
ggcagacgugcuuuggcucaagauggccuucauuuacguuuaguuuuuuuuaaaaccgugga

SEQ ID NO: 10685 - RNA, 62 nt, Human
cucagccucccgaguugcugggacuauaggugugcgccaccaugcccagcuaauuuuguauu

SEQ ID NO: 10686 - RNA, 62 nt, Human; identical to SEQ ID NO: 10684

SEQ ID NO: 10687 - RNA, 62 nt, Human
uucaggaccuugaggacacgugaccccacccgcccaccgccacuaucaggccccgggaccgc

SEQ ID NO: 10688 - RNA, 62 nt, Human; identical to SEQ ID NO: 9817

SEQ ID NO: 10689 - RNA, 62 nt, Human; identical to SEQ ID NO: 9818

SEQ ID NO: 10690 - RNA, 62 nt, Human
cuugaacucugccuuacagcagcaagaaaauuuuccucgacaagaaccucaaucuuuaguuc

SEQ ID NO: 10691 - RNA, 62 nt, Human
ccugaagugacacuuuuuccacaauuaacccaaguuguguuaauacuucaggucuguuuccc

SEQ ID NO: 10692 - RNA, 62 nt, Human
ugaugggguccucagagaccaggcgggccuccccacuacccagcugguaccugcagucaucc

SEQ ID NO: 10693 - RNA, 58 nt, Human
acucaacauccucuucacccugcccugccugcaguugagggggcgaagaagaacccug

SEQ ID NO: 10694 - RNA, 62 nt, Human; identical to SEQ ID NO: 10496

SEQ ID NO: 10695 - RNA, 56 nt, Human; identical to SEQ ID NO: 10497

SEQ ID NO: 10696 - RNA, 62 nt, Human
cacuuuucuagcucucccguuccccaucuccauugcucuguacucuuuucuuuuuucuugug

SEQ ID NO: 10697 - RNA, 58 nt, Human
acaagagauuaauaucuccaugcauaguuuuagacaaaaaaagauguuucaauaaaau

SEQ ID NO: 10698 - RNA, 62 nt, Human
agaaacuggcgcuuaaaccaaaucgcauggauuucuuuuucagugacguucaaguguuucuc

SEQ ID NO: 10699 - RNA, 59 nt, Human
ucagacauaaacaccccauuucuguaaacccaaauuauaugguuucuucugcgaaagag

SEQ ID NO: 10700 - RNA, 62 nt, Human
cagagccuaauuuauauucacuauccuuccaagucccggguagcagaaggguugccauagau

SEQ ID NO: 10701 - RNA, 62 nt, Human
uguucccgggacugaggcccgggaaagggaagcgacguggcagggccagcagcagacccugg

SEQ ID NO: 10702 - RNA, 62 nt, Human
uccggcgugaccgcgggaccccccacuacugcggccgagcgacggcccugcgcccgcccggg

SEQ ID NO: 10703 - RNA, 62 nt, Human
cccagcggggccaugccauggcagauaaagcucaggacgucaaaaacucaccauggacccca

SEQ ID NO: 10704 - RNA, 62 nt, Human
aauguccuguauuccagugaucauccucuaaacguuuuaucauuuauuaaucaucccugccu

SEQ ID NO: 10705 - RNA, 60 nt, Human
uuuacuccuuccucuuauuuuuuuaaaagauuaucgaacaauaaaaucauuugccuuuuu

SEQ ID NO: 10706 - RNA, 62 nt, Human; identical to SEQ ID NO: 10506

SEQ ID NO: 10707 - RNA, 62 nt, Human
uaacauggguuuccuuauugaaaaaucaguguauuagucauaaaacaccaucauuaagaaua

SEQ ID NO: 10708 - RNA, 62 nt, Human
cgaauuuugcacauggcggggucccgggaaggguggggagcaguuguccuuccugucgucgu

SEQ ID NO: 10709 - RNA, 62 nt, Human
agcagggagaguuccagaaagggggaugaaauaggaguauuaaaaagcugcguugguaaguu

SEQ ID NO: 10710 - RNA, 62 nt, Human
ugacucagaagagccaaaccucucagucacuuccacagccgagaaacacccagaaacucacu

SEQ ID NO: 10711 - RNA, 62 nt, Human
caacucgggagcauucugccugccugggaacgggguggacgagggagugucuguaaggacuc

SEQ ID NO: 10712 - RNA, 62 nt, Human
ccaaaugugcuuauuucuuugccuuagcacacguuuuauggaguacuuguuauacuagguuu

SEQ ID NO: 10713 - RNA, 60 nt, Human
aagaaaaugaggguuacaguaaccuguugucuuuauauaacuugcaacaaacuaauuuau

SEQ ID NO: 10714 - RNA, 62 nt, Human
cuccuguccucagagucauccugcgcucaugccuuuucccgaauggguucaccucuggcagu

SEQ ID NO: 10715 - RNA, 52 nt, Human
cuauauucacugugcuguccuagggggagggagagcagagcucgccccugca

SEQ ID NO: 10716 - RNA, 62 nt, Human
auaacuuguaauuuuuucuaauucauuucuuuucuuauuuuauuuccuccuuaacaguauuu

SEQ ID NO: 10717 - RNA, 62 nt, Human
gcaaaggcccuugagcagcgcggugugaaacugggauaaaaacggggcuuggccgaaggacu

SEQ ID NO: 10718 - RNA, 62 nt, Human
uuugaaaccaacguucacccaacuugucagaaauggcacuuacaugguucgaucuugcugga

SEQ ID NO: 10719 - RNA, 62 nt, Human
cacaugugcgcauuacacacacacaauacacauacaugcauauagacgcaucuauuggaaau

SEQ ID NO: 10720 - RNA, 62 nt, Human; identical to SEQ ID NO: 10704

SEQ ID NO: 10721 - RNA, 62 nt, Human
caauuagaaucguaaagugaauucuaucuauuuaauuggauauuggacucugcucauauaag

SEQ ID NO: 10722 - RNA, 62 nt, Human
uuuuauacacuuuuuaagccuuaacucgccauugauuuaccaguuuaacguuuccugggguu

SEQ ID NO: 10723 - RNA, 62 nt, Human
gcaccugcaggcagagaugcagagccuaaaggaccagguacaggagcugcaccgagaccuca

SEQ ID NO: 10724 - RNA, 62 nt, Human
gauccgccggcagcaacgagccauuaaaacugcaguuccugaccacgcacugcuucgcaggc

SEQ ID NO: 10725 - RNA, 60 nt, Human
cagcugaugccugccuugguuccuaccacucugguguagacagaggacuuuguccaaguc

SEQ ID NO: 10726 - RNA, 62 nt, Human
uguuguauacauuucuuauuuacgauuuucauuuguuauauauauauauaaauauacuguau

SEQ ID NO: 10727 - RNA, 55 nt, Human
cgcagacuugcauccugucacuaccacucguuagagaaagagaagaagagaaaga

SEQ ID NO: 10728 - RNA, 62 nt, Human
uuccauggcaaaugggcagcuccauccucuugacucuucuaaaugcccaaaagaggugucau

SEQ ID NO: 10729 - RNA, 60 nt, Human
ugcccuuccagccugaagaucugggggcacaguauagccacaugagccccaagugugguc

SEQ ID NO: 10730 - RNA, 62 nt, Human
acgagggcaaacagccaggacgcauuggagaggaauuugccaaagaucuacccugagauaac

SEQ ID NO: 10731 - RNA, 57 nt, Human
auuuaaaucuugagcuacauugguaaguaauaaauuauuuaaggccaggaauuccug

SEQ ID NO: 10732 - RNA, 62 nt, Human
guugagauggcccguguucauaacucaguuuccuguuuugcacgauguaaaaacccugucuu

SEQ ID NO: 10733 - RNA, 62 nt, Human
ucuuuucuuuccuauccuuucuuccccccucacugugaaaaauaacaguccaccccaaguca

SEQ ID NO: 10734 - RNA, 62 nt, Human
gccguucauguguuggaggccaaauguggcaaaccaaccccaggcccacccagagcgagcaa

SEQ ID NO: 10735 - RNA, 62 nt, Human; identical to SEQ ID NO: 10426

SEQ ID NO: 10736 - RNA, 62 nt, Human
aguugcagagcagccugggcaacauggugaaacccgucucuaccaaacagacaaaaagcagc

SEQ ID NO: 10737 - RNA, 60 nt, Human
ucaugaagaaccagcggaacucaaaacugcuguucaagaaaccucuucaagacuuuugac

SEQ ID NO: 10738 - RNA, 62 nt, Human
acucguuggaguuuaaaaauaagaguggaaaggaacguaauaugguguaggaauuggaaagc

SEQ ID NO: 10739 - RNA, 60 nt, Human
aaaagaaauuauggauuugucaauguaaguauuugucauaucugagguccaaaaccacaa

SEQ ID NO: 10740 - RNA, 62 nt, Human
ugugaugacuguaaauguucacuggguggguagggagugguauccaguguucaagugcagaa

SEQ ID NO: 10741 - RNA, 59 nt, Human
aaaguugccuuuucucuccacccuugaguagauccaguauuugaugaaacucaugaaag

SEQ ID NO: 10742 - RNA, 62 nt, Human
ccccagguggugaaucucuggcauguggcuuggcuuuguugagacuccaaauuccauuaucu

SEQ ID NO: 10743 - RNA, 62 nt, Human
cuaaucuuauucuaucuccugaagauuuaauugcuauuguuacccauucgaaaucagcugua

SEQ ID NO: 10744 - RNA, 62 nt, Human; identical to SEQ ID NO: 9588

SEQ ID NO: 10745 - RNA, 60 nt, Human
uccucacccacaggcgugugucacuguggcugggacggcagcgcucagaggagccuccag

SEQ ID NO: 10746 - RNA, 62 nt, Human
ggaggcggcugcgggucguggggaccaagcacauugguccuaaaggggcugaagagccugaa

SEQ ID NO: 10747 - RNA, 57 nt, Human
caggcgugugccacugcgcucggccucagauuccauauuugaacaccagcugauuga

SEQ ID NO: 10748 - RNA, 62 nt, Human; identical to SEQ ID NO: 10136

SEQ ID NO: 10749 - RNA, 60 nt, Human
cugggagaccaccccuugccacuugggccacuuccgccuaccccacuuuucauuuuguuc

SEQ ID NO: 10750 - RNA, 62 nt, Human; identical to SEQ ID NO: 10136

SEQ ID NO: 10751 - RNA, 60 nt, Human; identical to SEQ ID NO: 10749

SEQ ID NO: 10752 - RNA, 62 nt, Human
aaaauaaauaaauaaauaaauaaaaggcagcuugaguuuccaaacgugugauucacuuguga

SEQ ID NO: 10753 - RNA, 49 nt, Human; identical to SEQ ID NO: 9300

SEQ ID NO: 10754 - RNA, 62 nt, Human; identical to SEQ ID NO: 10107

SEQ ID NO: 10755 - RNA, 62 nt, Human; identical to SEQ ID NO: 10732

SEQ ID NO: 10756 - RNA, 62 nt, Human
gagcagaaccgaugagagccgcccuuaccguuggucuccggaucccccagucccaucccgcc

SEQ ID NO: 10757 - RNA, 61 nt, Human
caaucuagugauccaagucagaaaacugggaguuaucgcuacucuguuucauagaaauccc

SEQ ID NO: 10758 - RNA, 62 nt, Human
gcuuggccgaaggacuuuuaucugucuuggucaccccggccaggccccggaagcagcagcca

SEQ ID NO: 10759 - RNA, 62 nt, Human
cagcccugaggauggcaucuagugugcccgugcguggccauacccugccucccucucuggcc

SEQ ID NO: 10760 - RNA, 62 nt, Human
acugggggcaggacagccggaagcugagaccaaggcuccucacagaagggcccaggaagucc

SEQ ID NO: 10761 - RNA, 62 nt, Human
cacucguuuccccagugucauucaauaugcucuaaacgacgagguaaugcugaggcuauugc

SEQ ID NO: 10762 - RNA, 62 nt, Human; identical to SEQ ID NO: 9738

SEQ ID NO: 10763 - RNA, 60 nt, Human
gaucccucggggcggggguguguggucaggcugggcaccaggcacacagauguccguggc

SEQ ID NO: 10764 - RNA, 62 nt, Human
ggggaggggucugcacagcgagaaguacugugaugacuuugagccguugacauguaugucuu

SEQ ID NO: 10765 - RNA, 61 nt, Human
cgacuuagcaaaugggaccgguccccagggucaggcucuuagagcaggcacaagacuggga

SEQ ID NO: 10766 - RNA, 62 nt, Human
aggcgcucccuauuuggucucgcgacacagggacuauuuucagcacgcccacagugacugcc

SEQ ID NO: 10767 - RNA, 62 nt, Human
auguccaucauugcaugcguccauaccagggcugcaggccaagcccuggaaucccagcccug

SEQ ID NO: 10768 - RNA, 62 nt, Human
gcaaucuguauacaauuaagagauuucugacauuuauucuuacacuaaauggaucaacucua

SEQ ID NO: 10769 - RNA, 54 nt, Human
gcaucaacuacuuuuaaaguagaaaagcuauccauuuuauacaaucacugauac

SEQ ID NO: 10770 - RNA, 62 nt, Human; identical to SEQ ID NO: 9616

SEQ ID NO: 10771 - RNA, 62 nt, Human; identical to SEQ ID NO: 9617

SEQ ID NO: 10772 - RNA, 62 nt, Human
agaacgugaaagccagcucuuucagaauauccucuauuaauacugaauuuagauaucuuuau

SEQ ID NO: 10773 - RNA, 59 nt, Human
ucuucaagacuuuugacuuagaaccugcuauauuaucaagcuuaccuacuguuaucucu

SEQ ID NO: 10774 - RNA, 62 nt, Human
gcgggcucugaaggaaggcaagacaagcaugcauccgccguacucuuuggggcagcuggucc

SEQ ID NO: 10775 - RNA, 62 nt, Human
acugaggcugcgggcaccacgcgggguccggccugggauccaggcuaagggccggcggaaga

SEQ ID NO: 10776 - RNA, 61 nt, Human
cagcacuggugugaaugaaagagagacccagccgcgucucacacagguggaauugcacuuc

SEQ ID NO: 10777 - RNA, 62 nt, Human
cagucucuuccuggucugaacucccgccacauuuuagccguacuuugcuaacugugcuccuc

SEQ ID NO: 10778 - RNA, 62 nt, Human
cugaguuuuaauuuuuguccaaaguuauuuuaaucuauacaauuaaaaacuuuugccuauca

SEQ ID NO: 10779 - RNA, 62 nt, Human
caacuuguccuuuuguaccauggugugaaagucagaugcccagagggcccaggcaggccacc

SEQ ID NO: 10780 - RNA, 60 nt, Human
uuuuuauuuguuguuuguuuuccaugagguuaucggaccaugggcugagcucaggcacuu

SEQ ID NO: 10781 - RNA, 62 nt, Human
cacugugccuggguguauucuuuauacuguagauaauggagaaauuuucuaucucugucccu

SEQ ID NO: 10782 - RNA, 62 nt, Human
gggcacggaacaggagggucuggacccuguggcccagccaaaggcuaccagacagccacaac

SEQ ID NO: 10783 - RNA, 62 nt, Human
agguugugugauauuuuugcuugauagagaaucaaauuugaaacaauuaaccagccaguaga

SEQ ID NO: 10784 - RNA, 61 nt, Human
ucccuuuccuauugauuucccaccuuccagugaaauucugaaagucuuaucuuaaaaaucg

SEQ ID NO: 10785 - RNA, 62 nt, Human
cugcagcccucucugcacucccuaguccagaccuggggaccacuguggguuccugugggucu

SEQ ID NO: 10786 - RNA, 61 nt, Human
gcccuucuccccgggucugcccuguggggggcuuccggaaaagggaacccugcgguacccc

SEQ ID NO: 10787 - RNA, 62 nt, Human
augaaacgcagaggaugggugcccagaagcaccugcggcagaggcgcacgggaagcccgggg

SEQ ID NO: 10788 - RNA, 60 nt, Human
cuuauuuccugggcuggugcgccccaaaacacggccccgacacuuaguguggccccaggc

SEQ ID NO: 10789 - RNA, 62 nt, Human; identical to SEQ ID NO: 9933

SEQ ID NO: 10790 - RNA, 62 nt, Human
cucucagauccacgcccccauucaggaguucugacgacacgacagcaguagcaggacaggga

SEQ ID NO: 10791 - RNA, 62 nt, Human
uuggcauuagugaugguggugguacaguuggaauuagugccaugucauacacaaauguucca

SEQ ID NO: 10792 - RNA, 61 nt, Human
uagccaaggugggcugagcccuggcaggaugacccugcgaaggggcccugguccuuccagg

SEQ ID NO: 10793 - RNA, 62 nt, Human; identical to SEQ ID NO: 10791

SEQ ID NO: 10794 - RNA, 61 nt, Human
aguagcuccuggaaaaaaccuuaaaaaauguuuccuccaaaucugauuucauuacauuucu

SEQ ID NO: 10795 - RNA, 62 nt, Human
aauggaucuguugaagaacucagcugcuggaaaccaugcaaaauguuuugaauugcccuuaa

SEQ ID NO: 10796 - RNA, 62 nt, Human
cucuuaacacgguauccucgcuaguugguuuuaagggaaacacucugcuccugggugugagc

SEQ ID NO: 10797 - RNA, 62 nt, Human
uuccccaccguucccagguguacgaggcagagggccgggacagcuuuccucucagucauugu

SEQ ID NO: 10798 - RNA, 61 nt, Human
caucugcagauuauucccagucucccaguaacacguuucuacccagauccuuuuucauuuc

SEQ ID NO: 10799 - RNA, 62 nt, Human
ggagguuucaucaggauuuuggguuuuucacauuucacgcuaaggaguaguggcccugacuu

SEQ ID NO: 10800 - RNA, 62 nt, Human
gguccugaacuggggccggguggggaagagugagaugggauaacauagccccugcuuggagg

SEQ ID NO: 10801 - RNA, 62 nt, Human
guccacaguguauuagugacauucuuucauugacagcugacauaauucauugagugaaauau

SEQ ID NO: 10802 - RNA, 62 nt, Human
uuccccaucagccuucccaagguucuauccuguuccgagcaacuuuucuaauuauaaacauc

SEQ ID NO: 10803 - RNA, 62 nt, Human
cauucuuuguaucuucaguguugguuuguuuuagcugauccaucuguaacacaggagggauc

SEQ ID NO: 10804 - RNA, 60 nt, Human
cuucuuuacacuuguguaaauuucaguuacuggucauagaaggcuuucaauguugagugg

SEQ ID NO: 10805 - RNA, 62 nt, Human
uuuguuccuauggucacccccacuauccccaugaccgcaugaagaggcaguuauugcuuuag

SEQ ID NO: 10806 - RNA, 60 nt, Human
gacgcagcggcaccccucgguuauuaaggagggaggaguaggggauagaaguauuucaaa

SEQ ID NO: 10807 - RNA, 62 nt, Human; identical to SEQ ID NO: 9549

SEQ ID NO: 10808 - RNA, 60 nt, Human
guuucuccugucccuguucucccggagggcccagguggaacucacgacagggagggagac

SEQ ID NO: 10809 - RNA, 62 nt, Human
uucuaaaacuacugccuuucaaagugcacacacacgcguccacauacacugcauucguugcu

SEQ ID NO: 10810 - RNA, 56 nt, Human
aagcccggggcccaggcucaugcaacacgacgcucaccgcggcucgggccgugggg

SEQ ID NO: 10811 - RNA, 62 nt, Human
cagaauaaaccaguguuuucuacuuuggcaacucacgucacacacauauuacacacaugugc

SEQ ID NO: 10812 - RNA, 58 nt, Human
gagauaccuggagcgacggccucugcaccccgacgccaccaaaccacugacccacaga

SEQ ID NO: 10813 - RNA, 62 nt, Human
ggggccagccggacacaagcggcccugacacgugauggaccaaagccaccugcugcggggga

SEQ ID NO: 10814 - RNA, 62 nt, Human
gccauaagaaaaccacccacaagcucaacugugacccaagcagaaucuacaaaccccagaca

SEQ ID NO: 10815 - RNA, 62 nt, Human
agcuguuccuggacugacugcuggcuggcgaggaggcugcgagcguggaaucggaagcgacc

SEQ ID NO: 10816 - RNA, 62 nt, Human; identical to SEQ ID NO: 9338

SEQ ID NO: 10817 - RNA, 62 nt, Human
cgcugggagugggagggcagcacgggcgugaaggucggaggacagagaaaggucagcagggu

SEQ ID NO: 10818 - RNA, 49 nt, Human
uagaagaccguacucaguaacaggccggaaaauugugcucuagaagaau

SEQ ID NO: 10819 - RNA, 62 nt, Human
accaaaaccuugauuacagccauggggugggggugggggucaggggcgucugacuauggcug

SEQ ID NO: 10820 - RNA, 62 nt, Human
aucccaggauuaaaacuaaccgugaccacuacuccaaacaaaacacaauaugccuaggggca

SEQ ID NO: 10821 - RNA, 62 nt, Human; identical to SEQ ID NO: 10120

SEQ ID NO: 10822 - RNA, 62 nt, Human
gugggcauggagccagugccugugguuguuucuccagagucaaaagggaagucgagggaugg

SEQ ID NO: 10823 - RNA, 62 nt, Human
guugugugucgugugggaguggggcgauuuuuuaugugccaaauacccccgucccccccaug

SEQ ID NO: 10824 - RNA, 61 nt, Human
uagcuuccuucagaugacugaugucauaaguguauguaagacuuuuauuaaaucuuccuua

SEQ ID NO: 10825 - RNA, 49 nt, Human
agugugacagagaggugugagggaggcgaaggcccuggccuccgaggau

SEQ ID NO: 10826 - RNA, 60 nt, Human
uacagccccagguccuggcccagucccuccacugccucgaagagucagucugcccugccu

SEQ ID NO: 10827 - RNA, 62 nt, Human
ugccuccgagcagcgggugggcgugggccgcacagcgcggcagggccuuggcuaccacacgc

SEQ ID NO: 10828 - RNA, 60 nt, Human
aguuccacagcuggccgcgugggggggcccuugcaccgcacugccgccuccugacugccc

SEQ ID NO: 10829 - RNA, 62 nt, Human; identical to SEQ ID NO: 9337

SEQ ID NO: 10830 - RNA, 62 nt, Human
uccggucaaguucugacuuuauuacaggugugagcgaccacacggccucccaaaguucuggg

SEQ ID NO: 10831 - RNA, 52 nt, Human; identical to SEQ ID NO: 10498

SEQ ID NO: 10832 - RNA, 62 nt, Human
aggcugaucuuuaaaacccucgccuugcugacaggugcuuuaaaggcagucugcaucuuuuc

SEQ ID NO: 10833 - RNA, 62 nt, Human
aguauaaacuauaucagaagcuuacuugauaagccuugcggagcugcucugaggaauagugu

SEQ ID NO: 10834 - RNA, 62 nt, Human
gagcaggccggaaccacagggccagagggagcuggaacccgaggggccggggaagcugccag

SEQ ID NO: 10835 - RNA, 61 nt, Human
ccccagcgagcaucaugugagugggccucguuccccccggagaaucccagcggggccucag

SEQ ID NO: 10836 - RNA, 62 nt, Human
ccuuaaaugcccuuagucuguaagagaaugucccugaccgaaaucggccagaagccccucuc

SEQ ID NO: 10837 - RNA, 62 nt, Human; identical to SEQ ID NO: 10756

SEQ ID NO: 10838 - RNA, 62 nt, Human
ccaccgcgccuggccucagccaacaucaucuaagggcucucacggagggccucccagcugcc

SEQ ID NO: 10839 - RNA, 62 nt, Human
aaucauauguaccaaggauguuacaguaaacaggaugaacuauuuaaacccacuggguccug

SEQ ID NO: 10840 - RNA, 61 nt, Human
ucccccuuuacuggucucccuucccuucuccaugaacaauaaagacgaugucuuucucaac

SEQ ID NO: 10841 - RNA, 62 nt, Human
ugccuuuuguuuacacugguuauuuauuuaugacuugaaauaguuuaaggagcuaaacagcc

SEQ ID NO: 10842 - RNA, 60 nt, Human
auuggcagagccgggugcaggaagugcugccucuugccgagacgucggacagggcggggg

SEQ ID NO: 10843 - RNA, 62 nt, Human
gggugggugggugugacagcaggagcauugccaucuuggacaaacauggccauuuuaaguuc

SEQ ID NO: 10844 - RNA, 60 nt, Human
ucuccagagcccuuucugcacagcuggugucggcaucauacuaaaagcaauguuuaaauc

SEQ ID NO: 10845 - RNA, 62 nt, Human; identical to SEQ ID NO: 10211

SEQ ID NO: 10846 - RNA, 62 nt, Human
ugggacggcagcgcucagaggagccuccaguuacuuuccucacaucucccaaacucucucuu

SEQ ID NO: 10847 - RNA, 62 nt, Human
uguuguuccuuuuuugaaguugucauuaaaguaggugcaacaaccaagaaagugucucuucc

SEQ ID NO: 10848 - RNA, 62 nt, Human
gaaagucuuaucuuaaaaaucgauccgcuuaccaugggccuauucuuguaaguuucaguuag

SEQ ID NO: 10849 - RNA, 62 nt, Human
ugacuucuaaauguuucugcuucccagaaugcaccugacuuaugaaauggggauaauacucc

SEQ ID NO: 10850 - RNA, 61 nt, Human
aagacuccaccacugaguggcaccugcccuauugcaaaggaauccaguuccuccggaauaa

SEQ ID NO: 10851 - RNA, 62 nt, Human
ugcugaaacucacuagaccgucugccuguuucgaaauggggaaagccgugcgugcgcguuau

SEQ ID NO: 10852 - RNA, 56 nt, Human
guuggcaggagcuccuggaacuccacuucccucguaacucaagaccaggcugcagc

SEQ ID NO: 10853 - RNA, 62 nt, Human
caaggagggcucugacauucuuuuuaaaaacaccacaaagcaaaauucccaggacaugugua

SEQ ID NO: 10854 - RNA, 62 nt, Human
ugagccaccgugccuggucuguuuuuuuuuuuuuuuuggcaauagagucuugcucgcccagg

SEQ ID NO: 10855 - RNA, 62 nt, Human; identical to SEQ ID NO: 10853

SEQ ID NO: 10856 - RNA, 62 nt, Human; identical to SEQ ID NO: 10854

SEQ ID NO: 10857 - RNA, 62 nt, Human
auaauagaacauuauacaauugucaaaugaacuauaaugauaccuaaccauauggaugaauc

SEQ ID NO: 10858 - RNA, 62 nt, Human
gguuuccauguauucuaggccagguaggcaacacagagccaaggcgggugcuggaagccaga

SEQ ID NO: 10859 - RNA, 62 nt, Human; identical to SEQ ID NO: 10423

SEQ ID NO: 10860 - RNA, 62 nt, Human
acacccugccagagcaggaggccacuggcugugcugguccgaaccuccagcucgauggucuc

SEQ ID NO: 10861 - RNA, 62 nt, Human
caugauuguuuauggaaaguaucuuuaauaaagcuggauacaguuuggcuuggaaugcugcc

SEQ ID NO: 10862 - RNA, 60 nt, Human
uguauguggaaggauuaagaucucccccaggcagcuauaagaauauuuuaguuuuuuucu

SEQ ID NO: 10863 - RNA, 62 nt, Human
cagacaaaagguuacuuguguguuucucugagaagcgguguaaaugaagucaccuuagaaua

SEQ ID NO: 10864 - RNA, 62 nt, Human
uucgguguguaggccccagcugcccacuggaacugccggcuaaugcuugcucucccaagauc

SEQ ID NO: 10865 - RNA, 62 nt, Human
cuugaccccguuaucuauauuuuaaaugcuuuuugcccaacacugacccuauguucaacuuu

SEQ ID NO: 10866 - RNA, 62 nt, Human; identical to SEQ ID NO: 9695

SEQ ID NO: 10867 - RNA, 62 nt, Human
cugcagccgaccgcccugcuccggccccaguguggugggcgaggguggcgcaugggaggccg

SEQ ID NO: 10868 - RNA, 61 nt, Human
agaaaggaaagaaaggaaccagaggcagagagacgaggauacccagcgaaagggacgggag

SEQ ID NO: 10869 - RNA, 62 nt, Human; identical to SEQ ID NO: 10423

SEQ ID NO: 10870 - RNA, 53 nt, Human
acgcucaccgcggcucgggccguggggccgucagagaaaccuuuuuaaaaaau

SEQ ID NO: 10871 - RNA, 62 nt, Human; identical to SEQ ID NO: 9723

SEQ ID NO: 10872 - RNA, 59 nt, Human
cuucaguucaguguaacuauuuaauuguguggguccauagacuuuuuaaugaagauuuc

SEQ ID NO: 10873 - RNA, 62 nt, Human; identical to SEQ ID NO: 10586

SEQ ID NO: 10874 - RNA, 62 nt, Human
uuguuuuguagauggaguuucacuuuuguugcccaggcuggaguguaguggcgcgaucucgg

SEQ ID NO: 10875 - RNA, 62 nt, Human
gcuggugguucuuagguuuccuucuguuuguuaaaagggacaauguggccacuucucugugg

SEQ ID NO: 10876 - RNA, 60 nt, Human
gagauaccuggagcgacggcgacucugcaccccgacgccagcccaaaccacugacccaca

SEQ ID NO: 10877 - RNA, 62 nt, Human; identical to SEQ ID NO: 10875

SEQ ID NO: 10878 - RNA, 60 nt, Human; identical to SEQ ID NO: 10876

SEQ ID NO: 10879 - RNA, 62 nt, Human
ugguccccagcacguccagggugggugcucccuugcccgacagaaccauccccacugugagg

SEQ ID NO: 10880 - RNA, 62 nt, Human
aggaguccugaacugcugacgcgaaagaggcgcaguucccaauuaauacggaaaucgcugug

SEQ ID NO: 10881 - RNA, 62 nt, Human
uaaaaacugauugcuaaggugaaacaauucaaugcauaaguauggagcuaagugccuuuugg

SEQ ID NO: 10882 - RNA, 62 nt, Human
uaauuucagggaaaugaagauggaauuugaaggucacuuuuaaaauuaagucauugaugcug

SEQ ID NO: 10883 - RNA, 62 nt, Human; identical to SEQ ID NO: 10791

SEQ ID NO: 10884 - RNA, 62 nt, Human
caguagcuccuggaaaaaaccuuaaaaaauguuuccuccaaaucugauuucauuacauuucu

SEQ ID NO: 10885 - RNA, 62 nt, Human
augaauugauauggaaagaccguaucuucauuuucgugaguagaaggaaagauaagaaugag

SEQ ID NO: 10886 - RNA, 62 nt, Human; identical to SEQ ID NO: 10779

SEQ ID NO: 10887 - RNA, 62 nt, Human
gucuuauuuuuuuaaaaguucuguugcuuguauuaacacgaaacuagagagaaauaguuucu

SEQ ID NO: 10888 - RNA, 62 nt, Human
uuucuuucuuuuuuuuuguucguucauuuaaacguauauuuagaacugcacuuuguccacaa

SEQ ID NO: 10889 - RNA, 62 nt, Human; identical to SEQ ID NO: 10887

SEQ ID NO: 10890 - RNA, 62 nt, Human; identical to SEQ ID NO: 10888

SEQ ID NO: 10891 - RNA, 62 nt, Human
ccccuacccaccccuuuuccuucagcuguguuaggaaggagaaguuuucagaacccucuagg

SEQ ID NO: 10892 - RNA, 62 nt, Human
ccuccaccccugccucccuccugccccugcucccggggaggaaaggcuaaagcugcuggccc

SEQ ID NO: 10893 - RNA, 62 nt, Human; identical to SEQ ID NO: 10891

SEQ ID NO: 10894 - RNA, 62 nt, Human; identical to SEQ ID NO: 10892

SEQ ID NO: 10895 - RNA, 62 nt, Human
uccucugcugagaauccccacuugguguagggggagaggggaaaggggucuggcccaucgag

SEQ ID NO: 10896 - RNA, 62 nt, Human
ggcguguuguuugcucaggaaacagggcagccaggcccccaaaacugugucccccuggcugc

SEQ ID NO: 10897 - RNA, 62 nt, Human
uguguauauauauguuuguguauauauauacacauaugcauacauaugauuuuuuuuuuuca

SEQ ID NO: 10898 - RNA, 62 nt, Human
aaacugugaauggcccuaacuucaagggaaaugagaaaucgaaggaauuggcccaauggcga

SEQ ID NO: 10899 - RNA, 62 nt, Human
ugugaagaaauaauguuaauauaaguaucuggugaaggaccaaaaccgugugauaagguugu

SEQ ID NO: 10900 - RNA, 60 nt, Human
gugccccaggcuagcucuucuaccucuggggcaccacggacuccccuuggccacucuugg

SEQ ID NO: 10901 - RNA, 62 nt, Human
caugugccuguuucugccauguaaggaaggcucuucuagcaauacuagaucccacugagaaa

SEQ ID NO: 10902 - RNA, 62 nt, Human
uucauaguuaauacagguauaucuauuuuuauuuacuuuguaagaaacaagcucaaggagcu

SEQ ID NO: 10903 - RNA, 62 nt, Human
agcggaaggagggagcucugaugagcacgguuugucacacgauaaagggauuuuuuuuuuca

SEQ ID NO: 10904 - RNA, 62 nt, Human
gaaaguagugcuguaaauauucugccauaggaauacugucuacaugcuuucucauucaagaa

SEQ ID NO: 10905 - RNA, 62 nt, Human
uugugugcuuugcauauuuuguaaauauuuugcacgucauuauuuuucuuuuuuguuuaagc

SEQ ID NO: 10906 - RNA, 62 nt, Human
cuggugcauguauuuuucaaagauaaagaaaguguacugcgaaaauaugcaggaagauuaau

SEQ ID NO: 10907 - RNA, 62 nt, Human
gaguagcugggacuacagguuccuaccaccacacccggccaauuuuuguauuuuuaguagag

SEQ ID NO: 10908 - RNA, 62 nt, Human
ggacuucaacaugcacuucugcaggggccgcaguucagccaacaucaucuuuuuuuuugaga

SEQ ID NO: 10909 - RNA, 62 nt, Human
agagauacaccuaaaaauguauguacaacguuuucaccauaauauuaugcauaauaaggggc

SEQ ID NO: 10910 - RNA, 61 nt, Human
uauuauuuugacgguuuuuuuuuucggggcaggggaccuuaccuguaagacuuuuaaagau

SEQ ID NO: 10911 - RNA, 62 nt, Human
ucuuguauuguuuggaagaaaaaaugaugauagagucccaaaaagaagagaaaaaaaaugcc

SEQ ID NO: 10912 - RNA, 60 nt, Human
aggaagcggaaggggaaucgcgggaagcuggcccaggucagguccgcaaaggcuucugaa

SEQ ID NO: 10913 - RNA, 62 nt, Human
ggugggugcccaggagccggcccgcagcaccugcacacacgaaguccggacccacgcagccu

SEQ ID NO: 10914 - RNA, 62 nt, Human
guugguguguggggugggggcagggguagggcgggagagcgaugcuuggauuuuuguuuccu

SEQ ID NO: 10915 - RNA, 62 nt, Human
ggcacaucuguggucccagcuacuugagaggcugagccaggaggaucgcuugagcccaggag

SEQ ID NO: 10916 - RNA, 60 nt, Human
ccacuuuccaagggcuccaggaaucuggggccugaccacagauuccucucccauccuuuu

SEQ ID NO: 10917 - RNA, 62 nt, Human
agaaaaauaguaagcugguuuagaaacugacgagggcaaacagccaggacgcauuggagagg

SEQ ID NO: 10918 - RNA, 60 nt, Human
uaaaccaggcugcaucggaggccaggacccggaucauucacugugauacccugcccucca

SEQ ID NO: 10919 - RNA, 62 nt, Human
uuuuaugugccuuuuuguuuuuguaaaaaaggaacacccggaaagacugaaagaauacauuu

SEQ ID NO: 10920 - RNA, 62 nt, Human
uaugaaagaaaacaggcaaggaggcacugagggagaaagacacagacuuuaucgcucugugg

SEQ ID NO: 10921 - RNA, 62 nt, Human
cgcauaugcaugccaggcugggcacggcuccgagggcggccagggacagacgcuugcgccga

SEQ ID NO: 10922 - RNA, 59 nt, Human
ccuugaucuagaugggauucuuauaaaaauucaaccucagacauaaacaccccauuucu

SEQ ID NO: 10923 - RNA, 62 nt, Human; identical to SEQ ID NO: 10372

SEQ ID NO: 10924 - RNA, 60 nt, Human
cucacugccccgucacucccuucaaaggcgacagacccaagcccacgucaggagaggagc

SEQ ID NO: 10925 - RNA, 62 nt, Human
cugcccugagucugggacuucugccuccauggcuggucaugagagcaaaccguaguccccug

SEQ ID NO: 10926 - RNA, 61 nt, Human
uggugucauggcugaaguuggccaccuugcuugagggacaaguuguuuauguaucagcucu

SEQ ID NO: 10927 - RNA, 62 nt, Human
cccaucuuccuucccuccucugucccugccucggccaccccacgcgggaacccagcgccguc

SEQ ID NO: 10928 - RNA, 62 nt, Human; identical to SEQ ID NO: 9890

SEQ ID NO: 10929 - RNA, 62 nt, Human
cagaucagaaaaaacaaauagaagaaaaugaggguuacaguaaccuguugucuuuauauaac

SEQ ID NO: 10930 - RNA, 62 nt, Human
uuuauguaauuucccuaaaaagaaugaacuaccacuacacuaugguguuaaaccaaaauaua

SEQ ID NO: 10931 - RNA, 62 nt, Human
cggcaccaguuccccgagggacgcagcaggccgccucccgcagcggccgugggucugcacag

SEQ ID NO: 10932 - RNA, 62 nt, Human
aucuguucuucaggaaccgacuccucuccaguugcaacaccagggagaaaggggccuccaca

SEQ ID NO: 10933 - RNA, 62 nt, Human; identical to SEQ ID NO: 10931

SEQ ID NO: 10934 - RNA, 62 nt, Human; identical to SEQ ID NO: 10932

SEQ ID NO: 10935 - RNA, 51 nt, Human
acgacccguuacccaccuagaggaagcgcgaugcuggaacacaucccugcc

SEQ ID NO: 10936 - RNA, 62 nt, Human
caaaagagagagaucacucaaaugauuuuuauaaugaaaugacaagaauaacccuuuuggua

SEQ ID NO: 10937 - RNA, 62 nt, Human; identical to SEQ ID NO: 9514

SEQ ID NO: 10938 - RNA, 61 nt, Human
gccucccagguucaagcgauucuccuaccucagcccccagaguagcugggauuacaggcau

SEQ ID NO: 10939 - RNA, 61 nt, Human
gugagcuguggguggccuggguguguccuguggacggcggagacuguugauuuggauguug

SEQ ID NO: 10940 - RNA, 61 nt, Human; identical to SEQ ID NO: 10939

SEQ ID NO: 10941 - RNA, 62 nt, Human; identical to SEQ ID NO: 10687

SEQ ID NO: 10942 - RNA, 62 nt, Human
uguguggucccugggggugggcacuugggggcauccuggucacugcuggcccuagcauugga

SEQ ID NO: 10943 - RNA, 62 nt, Human
gggguucccucccuccugaagaugaacacacaauacacggaagagcgccagccucugcuuuc

SEQ ID NO: 10944 - RNA, 61 nt, Human
gaaacccucccugacccccacccuggccccccguauccccagcccuuggcaacacuggagu

SEQ ID NO: 10945 - RNA, 62 nt, Human
gguugaaaccagccugggcaacauagugagaccccaucucuacaaaaaguuuuaaaaccagg

SEQ ID NO: 10946 - RNA, 61 nt, Human
caaguagcuccccccacgacaugucucccuuucuuagaauauauuaaagucagagucucug

SEQ ID NO: 10947 - RNA, 62 nt, Human
accccagccucacccgaaaggccagccuggggcucuccggcaggcagcccgagaccugcaca

SEQ ID NO: 10948 - RNA, 60 nt, Human
guccaaacaagugaguggcccucgaggccacaguuaugcaacuuucagugugugucauaa

SEQ ID NO: 10949 - RNA, 62 nt, Human
uggggcgaggggaggagggggaucagcuucugcuauuaccgaccccccuucaugcugccccu

SEQ ID NO: 10950 - RNA, 62 nt, Human
acgaacaugcaguuauugaagauuaggaucaaggauagacaagguauaguaguuaucuuaaa

SEQ ID NO: 10951 - RNA, 62 nt, Human
caugauuugucugugaaagaaaauaauuuugagaucguuuuaucuauuuucucuacggcuua

SEQ ID NO: 10952 - RNA, 62 nt, Human
ucucuaaaaaauguuuccuuuauaaaagcacauggcgguugaaucuuaagguuaaauuuuaa

SEQ ID NO: 10953 - RNA, 62 nt, Human
ugguuuuguuuuaaacauucaacguuucuuuuccuucuacaauaaacacuuucaaaauguga

SEQ ID NO: 10954 - RNA, 61 nt, Human
ccauggauggaacuuccuuauauauuuauguaaauaaccuaguacuaugaucugcauggag

SEQ ID NO: 10955 - RNA, 62 nt, Human
aagaaaugaacaaaagcaaagcauuaguggcuauggucuguaaaaugaaacaaaaaaacuuu

SEQ ID NO: 10956 - RNA, 53 nt, Human
uuuuuguguuaauguaaaguugaauuucuaggaaacgugccuuuguuuuuuaa

SEQ ID NO: 10957 - RNA, 62 nt, Human
ucuccuccugcaaauaaaaccucacccaugaaugcucacgcaaguguaaugacagaccugaa

SEQ ID NO: 10958 - RNA, 62 nt, Human
aacaacugaugggggaagauggagauuucagaagacgggcgauaggcacagguguaaaaagg

SEQ ID NO: 10959 - RNA, 62 nt, Human; identical to SEQ ID NO: 10551

SEQ ID NO: 10960 - RNA, 62 nt, Human
ucugccuccugguguuacucuuugccaacagcuuuacggacauuggaugaagccgaagcauu

SEQ ID NO: 10961 - RNA, 62 nt, Human
ggcugggcgcgguggcucacgccuggaaucucagcgaggccaaggagaguggaucaccugag

SEQ ID NO: 10962 - RNA, 62 nt, Human
acccuuaagccccaggcuccccguuuaccucagagacgucuauuuuugugucuuuuuaaucg

SEQ ID NO: 10963 - RNA, 62 nt, Human
ccgagcaccagaagucauccccauugucuccacucgccauuaugaccaugagcaccauagca

SEQ ID NO: 10964 - RNA, 61 nt, Human
uuggguuuuugagauuugcuggugaagucagugacgaaaaauaaaccuucccuuaucuucc

SEQ ID NO: 10965 - RNA, 62 nt, Human
acuuggagacuccuggucugugaagagccgcugacgcccgcaggaaccgggcugggccuugu

SEQ ID NO: 10966 - RNA, 59 nt, Human
ugugugacccagacguacagagaggauuagcaggagguagggacugcagguagggccug

SEQ ID NO: 10967 - RNA, 62 nt, Human
aagaggccaggagcccccaugggccgcccaguaccaugcacacuccugucccgaacucccug

SEQ ID NO: 10968 - RNA, 62 nt, Human
ggagaagaaugaaauaagacgugaaguguaggaaaucaugaaaagaacaauuuugcaaauug

SEQ ID NO: 10969 - RNA, 62 nt, Human; identical to SEQ ID NO: 9485

SEQ ID NO: 10970 - RNA, 62 nt, Human
cucguguccugcuagcugucucucuuguugauuuccgugaaaaugcaaguguuugaagucug

SEQ ID NO: 10971 - RNA, 62 nt, Human; identical to SEQ ID NO: 9513

SEQ ID NO: 10972 - RNA, 62 nt, Human
uccucuugaugugagagagacucugagacuucuuccaucgcaaugaccuguauuaaacacaa

SEQ ID NO: 10973 - RNA, 62 nt, Human
gugcagcugucccauccagaccccgacuggccaagaccuccacguccccagaguccagcccu

SEQ ID NO: 10974 - RNA, 57 nt, Human
caugaugguuuuuuuuauuuuuuauuuuugagauggaguuucgcucuguugcccagg

SEQ ID NO: 10975 - RNA, 62 nt, Human
ggggucuggggcagggaaaugcuugacauuguuaacccaacaaaccuuuguugugauguccc

SEQ ID NO: 10976 - RNA, 61 nt, Human
aagcuuaagugggcagacacuguuugcccaguguuugugcaaggauggagugggugucucu

SEQ ID NO: 10977 - RNA, 62 nt, Human; identical to SEQ ID NO: 9792

SEQ ID NO: 10978 - RNA, 62 nt, Human
gccuggccagugugccacauuaaauacccgugcaggcgcggagaagcaaccggcacccccuu

SEQ ID NO: 10979 - RNA, 62 nt, Human; identical to SEQ ID NO: 9438

SEQ ID NO: 10980 - RNA, 62 nt, Human; identical to SEQ ID NO: 9439

SEQ ID NO: 10981 - RNA, 62 nt, Human; identical to SEQ ID NO: 10354

SEQ ID NO: 10982 - RNA, 62 nt, Human
acaugugcccaucaggcacagaagaaaacacgacgucguccauuuuggaagagacgaaagaa

SEQ ID NO: 10983 - RNA, 62 nt, Human
gguagcucugagcccuccuucuugcccugagcuuuccggggaggagccuuggaguguaauua

SEQ ID NO: 10984 - RNA, 52 nt, Human
uagcuuagcaccaaccaacacagucucaccuagaaaacagauggaagcuucg

SEQ ID NO: 10985 - RNA, 62 nt, Human; identical to SEQ ID NO: 10983

SEQ ID NO: 10986 - RNA, 52 nt, Human; identical to SEQ ID NO: 10984

SEQ ID NO: 10987 - RNA, 62 nt, Human
aucuccaggagccaccacucaacacaauggcccugccucccaccgcuuuauuucuuucgguu

SEQ ID NO: 10988 - RNA, 61 nt, Human
cacccuuggaacuugccucuuguccugcuggaaagauagcaguguucuccugacuucgccc

SEQ ID NO: 10989 - RNA, 62 nt, Human; identical to SEQ ID NO: 10023

SEQ ID NO: 10990 - RNA, 61 nt, Human
aaaaugcccaaguugcccuuuaaaaaaaaagagcguaaauacaaacaggaguggugcaagc

SEQ ID NO: 10991 - RNA, 62 nt, Human
uuaacaugccccugugaacagguauuuucaggacucaaacuaccacaaugaacagaguauag

SEQ ID NO: 10992 - RNA, 61 nt, Human
ugauucccuagaagagaacccucuacuuuuuguaagcacuacugacucucgcuguauuuaa

SEQ ID NO: 10993 - RNA, 62 nt, Human
cuucuuuggggaacccacaaggccugcgugcuugcuacgccaggcccucuuugcccuugguu

SEQ ID NO: 10994 - RNA, 60 nt, Human
cguguaaggaacugguggcuccaccagacccaacgugagagacccaggaaggaagagaag

SEQ ID NO: 10995 - RNA, 62 nt, Human; identical to SEQ ID NO: 10993

SEQ ID NO: 10996 - RNA, 60 nt, Human
cuaacugugauguuauuuguuuucuaagugguaugugagauuuucuaauguaguuagaag

SEQ ID NO: 10997 - RNA, 62 nt, Human
gaaaacaaauguguaacuuuuccaguuacuugacacgauucagugggggaaaaccagcauuu

SEQ ID NO: 10998 - RNA, 62 nt, Human
ucauugucugauggacacaauaugcccuuccgguucuauucaaaccagcaggaucugucggu

SEQ ID NO: 10999 - RNA, 62 nt, Human
auauuacacacaugugcgcauuacacacacacaauacacauacaugcauauagacgcaucua

SEQ ID NO: 11000 - RNA, 59 nt, Human
ucaaggcuuguugugaagccuaaaaauauucacaaauaagcuuuuaaacuggugucuuu

SEQ ID NO: 11001 - RNA, 62 nt, Human
gaggucacaaucuagcggagaaaggauguuacuagaaguacacaaauugggcccggcgcgau

SEQ ID NO: 11002 - RNA, 61 nt, Human
agaccgucagaaacuggagaguuucuauuaaaggucauuuaaaccacugaagggaagaugc

SEQ ID NO: 11003 - RNA, 62 nt, Human
uuucccucgugcugugucccgcucggguuccaauggacaguaucagggcuuguuugacuuag

SEQ ID NO: 11004 - RNA, 57 nt, Human
auguaaagcaucauugaaucaauggaucuguugaagaacucagcugcuggaaaccau

SEQ ID NO: 11005 - RNA, 62 nt, Human
cucaggugagggggcagcccacagaccugcuccucaguagcagggccuggccaggccccugc

SEQ ID NO: 11006 - RNA, 62 nt, Human
aguuauagcaacugcugcgggcgugcacauggcauaggcccaguaacuuacauacaucggcu

SEQ ID NO: 11007 - RNA, 62 nt, Human; identical to SEQ ID NO: 10522

SEQ ID NO: 11008 - RNA, 62 nt, Human; identical to SEQ ID NO: 10523

SEQ ID NO: 11009 - RNA, 62 nt, Human
ucacuggagauguuuaaaguuggccucuauccuaaugacucaaaacuugguucuuaacuacc

SEQ ID NO: 11010 - RNA, 62 nt, Human; identical to SEQ ID NO: 9792

SEQ ID NO: 11011 - RNA, 62 nt, Human
gcauccuggucacugcuggcccuagcauuggacccuaggagaccugacuggaacuggcuccc

SEQ ID NO: 11012 - RNA, 60 nt, Human
agucguccguucuggucguggggcggggcgcagggaaauacccccagcccugccggacug

SEQ ID NO: 11013 - RNA, 62 nt, Human
uagaaaugaaaagugagaaaauauuugaaagggauuauauuaauugcuaaauauuuuauuca

SEQ ID NO: 11014 - RNA, 60 nt, Human
gcagcuguuuugcccaagaccacugcuaccuguuuacccacccuggucccucccagacaa

SEQ ID NO: 11015 - RNA, 62 nt, Human
aaaaaauauuucccucacauuaaaagcaaauuuuuaauaucaggcucgaagagcaaaaugau

SEQ ID NO: 11016 - RNA, 62 nt, Human
ccaagcacuuugacauuugcaccuuaggagaggcagauguuaaaauggaauccaaagaccac

SEQ ID NO: 11017 - RNA, 62 nt, Human
caagcugugcguucuggaccagcuacugaauuauuaaucucacuuagcgaaagugacggaug

SEQ ID NO: 11018 - RNA, 62 nt, Human
aauuguugggguuuuuuuuguuguuuuguuuuguuuuguagauggaguuucacuuuuguugc

SEQ ID NO: 11019 - RNA, 62 nt, Human
ccugcuucccccuguggccggcaugccccgaucuuucacacacuggugacccugagagagga

SEQ ID NO: 11020 - RNA, 57 nt, Human
cgcgcaccacagggcagcacgggagacguugacaccaccggacgagaaagaaaaaag

SEQ ID NO: 11021 - RNA, 62 nt, Human
aagacuuuuaagugaguuuuuguucuuagauaacccacauuagaugaauguguuaagugaaa

SEQ ID NO: 11022 - RNA, 56 nt, Human
accaggagcugcucaugugcgugagagugggaaccaucuccuugcggcaguggcuu

SEQ ID NO: 11023 - RNA, 62 nt, Human; identical to SEQ ID NO: 9500

SEQ ID NO: 11024 - RNA, 62 nt, Human; identical to SEQ ID NO: 9501

SEQ ID NO: 11025 - RNA, 62 nt, Human
cacaaucucagggacccgagcagcuccaaggacgagaggauacagcagacacaaccuaauag

SEQ ID NO: 11026 - RNA, 57 nt, Human
uugggccuugcugagccaggguccucagggugaagcaggacugaggaguggccagcu

SEQ ID NO: 11027 - RNA, 62 nt, Human
agccucucuuacaggaauugugaaauauuaaaugcaaauuuacaacugcagaugacguaugu

SEQ ID NO: 11028 - RNA, 62 nt, Human
gauuauauuaauugcuaaauauuuuauucacaaaggucaauaacauggcaagauaaaauuau

SEQ ID NO: 11029 - RNA, 62 nt, Human
ucucaagaaaaggaaagggaggcugagcaguggcugaagcgaugcagccuugagacacgcug

SEQ ID NO: 11030 - RNA, 61 nt, Human
ucguuggcaccuucaauacuucaugauuuuugucgaguuuacuucaugaggaggucagccc

SEQ ID NO: 11031 - RNA, 62 nt, Human
uuacaguaaccuguugucuuuauauaacuugcaacaaacuaauuuauuuuuuuuuccuuuuu

SEQ ID NO: 11032 - RNA, 60 nt, Human
agugauuggguagcagcucacaucccacccagcuucacaagugaggaacccaggugcauc

SEQ ID NO: 11033 - RNA, 62 nt, Human; identical to SEQ ID NO: 10153

SEQ ID NO: 11034 - RNA, 60 nt, Human
ggugggugguggauucuuggacgugugugucauacaagcauagacuggauuaaagaaguu

SEQ ID NO: 11035 - RNA, 62 nt, Human
aggccacccucgcuuguccuggcgcccggcggcagcugcccagaaacuuccugggagaaaga

SEQ ID NO: 11036 - RNA, 62 nt, Human
cuggcaggugcagacagccuuugcugguccccagcacguccagggugggugcucccuugccc

SEQ ID NO: 11037 - RNA, 62 nt, Human
aaaaaaaaaaaaaaccugacaaaagaaauaguaugaaaaguagaaaaaugucacguuuccau

SEQ ID NO: 11038 - RNA, 62 nt, Human; identical to SEQ ID NO: 10488

SEQ ID NO: 11039 - RNA, 62 nt, Human
cccuugccagguuucaggcacccguggaugagcagucagagagucuacagaacacgcacgac

SEQ ID NO: 11040 - RNA, 62 nt, Human
aagaccguacucaguaacaggccggaaaauugugcucuagaagaauaaaacugaaaaacucu

SEQ ID NO: 11041 - RNA, 62 nt, Human
uguuacccauucgaaaucagcuguacugugugaacgaaauaaagacaauaauacgaaccccu

SEQ ID NO: 11042 - RNA, 60 nt, Human
uaauugauaaugguaccaccuucuauaauaauaauauaaaauaaaaacaucugaugucug

SEQ ID NO: 11043 - RNA, 62 nt, Human
ccuucacuuuacccccacagaagucuagaggcgucuguuauaaagcguuacggggcgccugc

SEQ ID NO: 11044 - RNA, 62 nt, Human
uugguucccuuguguguguguguugaucccaagacaaugaaaguuugcacuguaugcuggac

SEQ ID NO: 11045 - RNA, 62 nt, Human
cgccuguccagugucuucaccacgugaauaaccagcgcuccaaaguguuuuucugcuuugaa

SEQ ID NO: 11046 - RNA, 62 nt, Human
guuuuuguuuuuguuuuuuuaaaggaaacuauuugugggcuauaggaaacuuucugaugccu

SEQ ID NO: 11047 - RNA, 62 nt, Human
uuuuuuaaaaguaauuuugcauugcuuugaaauuugagcucauuugcaaacccgagucugcc

SEQ ID NO: 11048 - RNA, 62 nt, Human
gcaaaaggaagaaaagaaauguuuaauguucagaccugccaagagccuccaacagggcucaa

SEQ ID NO: 11049 - RNA, 62 nt, Human
uugcaaaacagauaaucauaagaugaaucaguauguagcuuaacaccauccacucacuccaa

SEQ ID NO: 11050 - RNA, 62 nt, Human
ggcagugccaugggggcaacagccaaaauagggggguaaugauguaggggccaagcagugcc

SEQ ID NO: 11051 - RNA, 62 nt, Human
gauuaggaaaaucgaccuuuucauccaugaugaccauccucauagcucagaucuccuuucaa

SEQ ID NO: 11052 - RNA, 62 nt, Human; identical to SEQ ID NO: 10707

SEQ ID NO: 11053 - RNA, 62 nt, Human
gagugaacccucugucccugagcuaacccacauacuagcagaggaggaagucagagucggcc

SEQ ID NO: 11054 - RNA, 60 nt, Human
gacgugccacggggaggcuccugcaggaggcucaacccgacggaucacagugaaagggau

SEQ ID NO: 11055 - RNA, 62 nt, Human
caacugaagauccacaaaauaagugaaaagagccuuaacugaugacauuccaccauugugau

SEQ ID NO: 11056 - RNA, 60 nt, Human
acggcagcgcucagaggagccuccaguuacuuuccucacaucucccaaacucucucuuaa

SEQ ID NO: 11057 - RNA, 62 nt, Human
ugcaugggaaauaaugagaagcagcucacagaguuuaaacuauuuucuuguccccaccaccu

SEQ ID NO: 11058 - RNA, 62 nt, Human
gcauuuauuucugugcccuuaaacccauuuagaaaauaacuacaaaguaaaaauguagagga

SEQ ID NO: 11059 - RNA, 62 nt, Human
gauagguccuacugcaaaccaccccuccauauuuccguaccauuuacaauucaguuucugug

SEQ ID NO: 11060 - RNA, 62 nt, Human
gugcagcggguuuggcucauuugaaaaugaggguccgugguagcugugcguuuugcuaucau

SEQ ID NO: 11061 - RNA, 62 nt, Human
gcucaugauguucuuucuggagguucaacacuacguaccgcacuuuauaauuuaacuggaau

SEQ ID NO: 11062 - RNA, 52 nt, Human
aucgcgggaagcuggcccaggucagguccgcaaaggcuucugaagaagagga

SEQ ID NO: 11063 - RNA, 62 nt, Human
guauaagugcgcuucgguacagcacggguccugcucccgcgauguggaagugucacacggca

SEQ ID NO: 11064 - RNA, 62 nt, Human
gugacagagaggugugagggaggcgaaggcccuggccuccgaggaucuggguggcgucugcu

SEQ ID NO: 11065 - RNA, 62 nt, Human
accuuggagggugggcaggacacaguugauugucucuacagagcugugacgggggcacugag

SEQ ID NO: 11066 - RNA, 60 nt, Human
aaaagaaacuuuuucuugauaaaggaauaaugguggucuagcuaguucuuguaaaaguga

SEQ ID NO: 11067 - RNA, 62 nt, Human
aggcuuguaguuuagaagggaaguaggcauuaccauagacgacuccuagaggacagugcuau

SEQ ID NO: 11068 - RNA, 59 nt, Human
acuuuccagaaucaagugccuucugcaaaucauguuggaaaaguccaaaccuggagaug

SEQ ID NO: 11069 - RNA, 62 nt, Human; identical to SEQ ID NO: 10341

SEQ ID NO: 11070 - RNA, 60 nt, Human
cgauacguuuggucuuucaugcugaaaaauaaauaauaaagccugucccgugucuacugc

SEQ ID NO: 11071 - RNA, 62 nt, Human
gccuucuccccucucccagggaugcucuuuguaaauaucggaugggugugggagugaggggu

SEQ ID NO: 11072 - RNA, 60 nt, Human
uccaugugccagaggcuccgguccaugcaguacaauggcagcuacuucgacagaggagcc

SEQ ID NO: 11073 - RNA, 62 nt, Human
gcuccucuaaacauuugcuguucaaacauguuuuugaauauacauucuauaaaagauuauuu

SEQ ID NO: 11074 - RNA, 57 nt, Human
uucaauuuagucuauccuggauauguacuaacgaauauuaccaccagagaagagagc

SEQ ID NO: 11075 - RNA, 62 nt, Human
ggaaucaaaagggacagaaggagagacagggcuggggucguacccugcuggggcguguccag

SEQ ID NO: 11076 - RNA, 62 nt, Human
cacuugagugaagaugagaauagauccuauguggagauuguagaagaugggucuggugaucu

SEQ ID NO: 11077 - RNA, 62 nt, Human
ggcgagagagaaacagcuacugcgugcgugcgcgcacgcauacacacacacacacacacacu

SEQ ID NO: 11078 - RNA, 62 nt, Human
gcagaggccagaccagggccgaucuggguguccugacccucagcuggcccugcccagccacc

SEQ ID NO: 11079 - RNA, 62 nt, Human
agaucagcccuucccagggucugcaggugucacaugaucacaguucagcgggaggcuuuccg

SEQ ID NO: 11080 - RNA, 60 nt, Human
cacuucuguauuguguggucuuaacugccuaaggcggcaaugggcagugggccccuuucc

SEQ ID NO: 11081 - RNA, 62 nt, Human; identical to SEQ ID NO: 10672

SEQ ID NO: 11082 - RNA, 62 nt, Human
caguggaucugauggccgcggugagguggguucucaggaccacccucgccaagcuccagggu

SEQ ID NO: 11083 - RNA, 62 nt, Human
auaaacccccaucugaccagaaacaugccaauccugagaauaaccuccccuccagccagaga

SEQ ID NO: 11084 - RNA, 61 nt, Human
ucaguucauugaccagaugacagccacgugaugauuagggaaggacggaugcauugcgauu

SEQ ID NO: 11085 - RNA, 49 nt, Human
cccugcuggaccugcccuaggggcgggaagccagggccgcaccggcuuu

SEQ ID NO: 11086 - RNA, 62 nt, Human
ucucgucaucgccuccaugucccuccuuuccuccucgcgugacugggccuggaagaagcccu

SEQ ID NO: 11087 - RNA, 62 nt, Human
uggaagaaaaaaugaugauagagucccaaaaagaagagaaaaaaaaugcccaaguugcccuu

SEQ ID NO: 11088 - RNA, 56 nt, Human
cagacccugaguccuugggccagcucuuggcuaagaccaggaggcugcaagucucc

SEQ ID NO: 11089 - RNA, 62 nt, Human
aacacgggauggcgcccaaacuccggcguucacaagaggagacgugacguggugggcugagg

SEQ ID NO: 11090 - RNA, 62 nt, Human
ucuuguccccccaggcuccccaccucugcaagaugggauacacucuucaggaccacaguuug

SEQ ID NO: 11091 - RNA, 62 nt, Human; identical to SEQ ID NO: 9544

SEQ ID NO: 11092 - RNA, 62 nt, Human
ggcggauuuuuuuuuuaacuuucuucuuccuguuaaaacauaggucacuaacugugauguua

SEQ ID NO: 11093 - RNA, 62 nt, Human
gugcugcugucaccaggcaccuuuguuuuucaagacaacauacuuuuuuuuucuuuucucug

SEQ ID NO: 11094 - RNA, 60 nt, Human
auagacuggugugcucaaaagagagagaucacucaaaugauuuuuauaaugaaaugacaa

SEQ ID NO: 11095 - RNA, 62 nt, Human
cacaggauuccguuggugaaccuguaaaaacaaaacaaacaaaacaaaacaaaaaagacaaa

SEQ ID NO: 11096 - RNA, 62 nt, Human
ugcacugcagcaugggcaacaagagucaaacucccucuaaaaaaaaaaaaaaaaaaagggcc

SEQ ID NO: 11097 - RNA, 62 nt, Human
guuaagcuuuguguccccacccacaucucaucuugaaugguaauccuggguguuuagggaga

SEQ ID NO: 11098 - RNA, 53 nt, Human
uuugugagacauaaauucuuuuauuacgauuuaccucuaauuuauuacacuua

SEQ ID NO: 11099 - RNA, 62 nt, Human
gcgggcagaucccugccauuuaggugccuaagcaaaaggacaggcuguccaagguagaaacu

SEQ ID NO: 11100 - RNA, 56 nt, Human
gcggcaucuggcggacccucaugagccugucgugcaggccaggucauuggccccuu

SEQ ID NO: 11101 - RNA, 62 nt, Human
ggagucugcuccugagaagcuucaaauucaggccaggagagaagucuuaagaaaagaccucc

SEQ ID NO: 11102 - RNA, 62 nt, Human
gagcaggggggaccccaaccccacaccccagcgcccagugcauuggcagagccgggugcagg

SEQ ID NO: 11103 - RNA, 62 nt, Human
uugacugcagagucuauuuaagcaugugguuuuaaaaauagacaguauuuuuuaaaaaucaa

SEQ ID NO: 11104 - RNA, 62 nt, Human
uuuuuuuaauccaauauccguugauuugauugugauuagagaaccuuggacauuuugcugcu

SEQ ID NO: 11105 - RNA, 62 nt, Human; identical to SEQ ID NO: 9502

SEQ ID NO: 11106 - RNA, 62 nt, Human; identical to SEQ ID NO: 9503

SEQ ID NO: 11107 - RNA, 62 nt, Human
gagcugagaccauggaauugcacugcagcaugggcaacaagagucaaacucccucuaaaaaa

SEQ ID NO: 11108 - RNA, 60 nt, Human
gagugugggguggggaagucccuucccaacggaggucccagccuauggcccugggcccag

SEQ ID NO: 11109 - RNA, 62 nt, Human; identical to SEQ ID NO: 9560

SEQ ID NO: 11110 - RNA, 62 nt, Human; identical to SEQ ID NO: 9542

SEQ ID NO: 11111 - RNA, 62 nt, Human
augcuuucaaaagcuaaucugccuguugaugguaacuagguacagcgacuuuaaauacaguu

SEQ ID NO: 11112 - RNA, 62 nt, Human
ccuuuaaaaaaaaagagcguaaauacaaacaggaguggugcaagccgccuugguguggguuu

SEQ ID NO: 11113 - RNA, 62 nt, Human
cgccagcuccucucugaagcgacucuccuguuuggaacggcaaaaaaaaauuuuuuuuucuc

SEQ ID NO: 11114 - RNA, 61 nt, Human
uucuacuggccaaguucaagugaguaagccgcgucccccaacuacagcuggagacggggcc

SEQ ID NO: 11115 - RNA, 62 nt, Human
gaugcgcuuuugucccguaaauguuaacacucaugaagcauaccccggccucucaguucuug

SEQ ID NO: 11116 - RNA, 50 nt, Human
uccugcguguccuccccuccacugccugcauggggggcgcggggagugac

SEQ ID NO: 11117 - RNA, 62 nt, Human
caucccucccaaucuugcccacacacugagaaguaacucggagcuacagucuguuaaaaaug

SEQ ID NO: 11118 - RNA, 62 nt, Human
guauccccagcccuuggcaacacuggagugcacacgccgccacgguugcccagaaaaagugc

SEQ ID NO: 11119 - RNA, 62 nt, Human
agcaguuucaaaacucuaccauggauaaugcaaacaaaccgaagcuacaugccaaugauagg

SEQ ID NO: 11120 - RNA, 53 nt, Human
cgucagagaaaccuuuuuaaaaaauggagaugaauguuacagaauuggacaac

SEQ ID NO: 11121 - RNA, 62 nt, Human
ugcguguuucgaagugggaugacagucggccacggaaaacaagaggaagccucggccucccu

SEQ ID NO: 11122 - RNA, 62 nt, Human
agacgccuggguugucaggcucaauccuugagccucaaccaaggagcagaggggugcgggua

SEQ ID NO: 11123 - RNA, 62 nt, Human
ccuuccccagcugccccuccuucuagaaccucugcacaucuagccucuggcccuccucuuca

SEQ ID NO: 11124 - RNA, 62 nt, Human
gaagcuuaagugggcagacacuguuugcccaguguuugugcaaggauggagugggugucucu

SEQ ID NO: 11125 - RNA, 62 nt, Human
cggcaccuguacaaaaagacuggcuaaccccucuuccuauuaccuugaucucuucccccaac

SEQ ID NO: 11126 - RNA, 62 nt, Human
guauguuuacaccugguguccaauuuuguauuuuaaaauguaauccauuuuuacuucagcuc

SEQ ID NO: 11127 - RNA, 52 nt, Human; identical to SEQ ID NO: 10498

SEQ ID NO: 11128 - RNA, 62 nt, Human; identical to SEQ ID NO: 10499

SEQ ID NO: 11129 - RNA, 62 nt, Human
aagguuugagguagacucugaccgucucauaaaagaguucuacccagcaguuggcagauuau

SEQ ID NO: 11130 - RNA, 62 nt, Human
cacagcucuuccgugucaucuucauccccuuccuuuaaucaaaggcugaaaucucugccuga

SEQ ID NO: 11131 - RNA, 51 nt, Human
ggucagagaagcagccaugacugcggggggaggacacacggaugcucaggc

SEQ ID NO: 11132 - RNA, 61 nt, Human
ggaugccaacucccuggcaggggcaggacugcugccgagcagccccaccugcccucccagc

SEQ ID NO: 11133 - RNA, 62 nt, Human; identical to SEQ ID NO: 9845

SEQ ID NO: 11134 - RNA, 62 nt, Human
ccaacuaagaaaccacuauuauauauuuuuucccuucagucacauagacuucagacaacucu

SEQ ID NO: 11135 - RNA, 62 nt, Human
aagaccaccugugaacuugaucauuaucuggcccaaauaugaagauaaacuauaacuuugga

SEQ ID NO: 11136 - RNA, 57 nt, Human
cguguuugcauggcaugaagucuucguccuugucacaguagcuugggaugacuccca

SEQ ID NO: 11137 - RNA, 62 nt, Human
uguuuaaaagcaaggcaugcuuguggaugacucuguaacagacuaauuggaauuguugaagc

SEQ ID NO: 11138 - RNA, 62 nt, Human
agucucuguucgcucgcuuaagcuguuuugaagccaagugaagagugugguuugcauccaag

SEQ ID NO: 11139 - RNA, 62 nt, Human
aggacaucuguguguaugugcguauuuaaauuagauuauuuauaauaaccagagccagcccu

SEQ ID NO: 11140 - RNA, 62 nt, Human; identical to SEQ ID NO: 10611

SEQ ID NO: 11141 - RNA, 62 nt, Human
accccucccaccccugccuugccggccccugcacauuuaggauaugcuccuggguggggacu

SEQ ID NO: 11142 - RNA, 61 nt, Human
aagagcauugaacugaggaaagcuaagaggaagauucaauauuaacuagcuugaagccuga

SEQ ID NO: 11143 - RNA, 62 nt, Human
uuguaacuuacuggacuuuuguggaaaauaucagcgucgcuacccucagaaacaaacuaaca

SEQ ID NO: 11144 - RNA, 62 nt, Human
uggccacacgccuguucccagcaagugcugaaacucacuagaccgucugccuguuucgaaau

SEQ ID NO: 11145 - RNA, 62 nt, Human
cauggacucaggaccugcccggugaugcuguugauuucucaaaggucuuccaaaacucaaca

SEQ ID NO: 11146 - RNA, 60 nt, Human
aaguagaagaaaccacaaauuaucuugugccugaaauccauuaagaggccugauagcuuu

SEQ ID NO: 11147 - RNA, 62 nt, Human
uucauucaauucaugaaacaaaucuuugccaagagcaguuuaugugccaggaacaucauucu

SEQ ID NO: 11148 - RNA, 62 nt, Human
cgauggaggcagaaccggagucggguuuggggaaguugucaaggaaugagggaaaguaaauc

SEQ ID NO: 11149 - RNA, 62 nt, Human; identical to SEQ ID NO: 10958

SEQ ID NO: 11150 - RNA, 62 nt, Human
cuaugggugacugccuucucccagaguuuucuuuggagaacagaaagaagaaaggaaagaaa

SEQ ID NO: 11151 - RNA, 62 nt, Human
cccaccuguuuggaugggaguagaggaaguugguguagaccagcuguggagcugaaggcaca

SEQ ID NO: 11152 - RNA, 59 nt, Human
acaaauccuggcccuggacucgguuucccagcgcggucaacgcaucuggaggggacugg

SEQ ID NO: 11153 - RNA, 62 nt, Human
agcagagccaggugagggggggccugccaggacuagacagaaguggggcggccugaacccug

SEQ ID NO: 11154 - RNA, 61 nt, Human
guccuggucuuuguuugaggccugacgugggcaucauuuuaacaggugccuuuuuuguuuu

SEQ ID NO: 11155 - RNA, 62 nt, Human
ccgcccaccucggccucccaaaaugcugggauuacagggguaagccacugugcccggccggu

SEQ ID NO: 11156 - RNA, 61 nt, Human
auacgcagcacuggcuguuaagauggggaagggguacaucaggauuccacucauagcccug

SEQ ID NO: 11157 - RNA, 62 nt, Human
agaagccuccgagaagugcuuuaaguguguuugcaugcgccaggcggugggcagcgggggcc

SEQ ID NO: 11158 - RNA, 62 nt, Human
aagaucacauguccccagagaggcacccccaggcaagcucgagggggccacaccguguccca

SEQ ID NO: 11159 - RNA, 62 nt, Human
uuuaaauuauucaugugucccuuaaaaguuucacuacguggagaaaauuccagcaccaagug

SEQ ID NO: 11160 - RNA, 57 nt, Human
ugaauacauaucacguauuuuagacucgaagccucaaagcacuggauuguggucccc

SEQ ID NO: 11161 - RNA, 62 nt, Human
ccagccucuguguugagguugccggggguagggguggggccacacaaaucuccaggagccac

SEQ ID NO: 11162 - RNA, 62 nt, Human
agggaacaaaugguuggcaugcagcccccucaggcgccccgagaccucaucuuccggugagu

SEQ ID NO: 11163 - RNA, 62 nt, Human; identical to SEQ ID NO: 9589

SEQ ID NO: 11164 - RNA, 57 nt, Human
uuuuuuuuucaaguauuggaagggguggggagauauauaaauaaaucaugaaaucaa

SEQ ID NO: 11165 - RNA, 62 nt, Human
caauggugcgcggaagccaggcgggcgauuacaauccaauuaccuauugucgacucagccca

SEQ ID NO: 11166 - RNA, 62 nt, Human
caagucugaagcuguagauacuggaagacaaugcaccuuggagggugggcaggacacaguug

SEQ ID NO: 11167 - RNA, 62 nt, Human
uucucuuaguugagcacagaacccucagcucuggugcgggcagaucccugccauuuaggugc

SEQ ID NO: 11168 - RNA, 61 nt, Human
gggcagccgggggccgguggccagagcgagggcaccagccacgaaggacggaggcgggcgg

SEQ ID NO: 11169 - RNA, 62 nt, Human
ggcugggugccguguuacuaacucuaguauguuucugugucaaucgcugugaaauaaagucu

SEQ ID NO: 11170 - RNA, 62 nt, Human
uuucaccaucuuccuguccugccugacaguucgcucauuccaacuaaucaucaucuucaagu

SEQ ID NO: 11171 - RNA, 62 nt, Human
ccacuaacaucccagacuuuaaaauucaguaaaucagauguacaccgagccugcagucucgc

SEQ ID NO: 11172 - RNA, 62 nt, Human
gcacaacgucuuaccgugccuauuaccaagcgaguguuuguaaccauguaguuuuggaaccc

SEQ ID NO: 11173 - RNA, 62 nt, Human
acugcgcuuucggcacgagggaugcugagcccuggugucagagucguaauuuaaagcgugug

SEQ ID NO: 11174 - RNA, 62 nt, Human
cuacuguccccuaccuuggaccccacccuggggaagcguugacacuccucccccgagaccac

SEQ ID NO: 11175 - RNA, 62 nt, Human
cagugacuggccaucacauuaaugaaugacgagauuggaguacacugucaccaagggcaggc

SEQ ID NO: 11176 - RNA, 62 nt, Human
guuuguuuuaaucucuacagcacauuuaaugcaacuuuugaaaucugcagguuuuuaauguc

SEQ ID NO: 11177 - RNA, 62 nt, Human
uggucccugcagggcaaugugggcaucuggaccuggggacgauguggaugcacuucuuggaa

SEQ ID NO: 11178 - RNA, 59 nt, Human
cugcccacucaccugcccgccugcccgcccgcccgcauagcacuugcagaccugccuga

SEQ ID NO: 11179 - RNA, 62 nt, Human
aacugucaacaaaugauaccuuuggauauccauccuccucgacuuauaguacagugguguau

SEQ ID NO: 11180 - RNA, 59 nt, Human
cccagccccagccccaggcccagcugccuuuggcuuugaucucaagucaggcugaaggc

SEQ ID NO: 11181 - RNA, 62 nt, Human; identical to SEQ ID NO: 11179

SEQ ID NO: 11182 - RNA, 59 nt, Human; identical to SEQ ID NO: 11180

SEQ ID NO: 11183 - RNA, 62 nt, Human; identical to SEQ ID NO: 10276

SEQ ID NO: 11184 - RNA, 59 nt, Human
aaaaaaccuuaaaaaauguuuccuccaaaucugauuucauuacauuucugaauuguugg

SEQ ID NO: 11185 - RNA, 62 nt, Human; identical to SEQ ID NO: 9791

SEQ ID NO: 11186 - RNA, 62 nt, Human; identical to SEQ ID NO: 9792

SEQ ID NO: 11187 - RNA, 62 nt, Human
ccgccuuacugccgccuaccccgcccgccacgccgccgucgaugccagcgcuguccccacgg

SEQ ID NO: 11188 - RNA, 62 nt, Human
guggaacuuacucuuucuuuuaagauaaguuguagacuucgauguuucaugcucauguacuu

SEQ ID NO: 11189 - RNA, 62 nt, Human
ggguuucccuuugggccucaguguuacaaauuacuagugcuauuuucauuauuauuguaaug

SEQ ID NO: 11190 - RNA, 60 nt, Human
agaucaggaguucaagaccagccuggccaauaugaugaaaccccgucucuacuaaaaaua

SEQ ID NO: 11191 - RNA, 62 nt, Human
auuugaacuuagggcaaaucagagucuacacagacgccuacagaaaguuucaggaagaggca

SEQ ID NO: 11192 - RNA, 62 nt, Human
gugcuauaaucuagauguaauguugucacuaauuaauugccauuacucccaguuaguuaccc

SEQ ID NO: 11193 - RNA, 62 nt, Human
ucgagcugugcccugggcaucacugagcagaggggugcggcagcuucaggaggcagaaacga

SEQ ID NO: 11194 - RNA, 61 nt, Human
augcugcccgguugccauggagaucugaaggggcgggguuagagccaagcugcacaauuua

SEQ ID NO: 11195 - RNA, 62 nt, Human; identical to SEQ ID NO: 9307

SEQ ID NO: 11196 - RNA, 59 nt, Human
gccgggggccgguggccagagcgagggcaccagccacgaaggacggaggcgggcggggc

SEQ ID NO: 11197 - RNA, 62 nt, Human
acacuucugagagcugccaccccaggagcagcucagauagaaucagcuggagaccacagcau

SEQ ID NO: 11198 - RNA, 62 nt, Human
agggcuggugcccggcccagggugcccagcggggccaugccauggcagauaaagcucaggac

SEQ ID NO: 11199 - RNA, 62 nt, Human
ucuuagaacucauacuaucuguauacaugugcacaugcggcauuuuacuaugaaauuuaaua

SEQ ID NO: 11200 - RNA, 62 nt, Human
cugcgugccacagccccgccucccugccuggagcacacuuuagaauucugaagaugugaagc

SEQ ID NO: 11201 - RNA, 62 nt, Human
aauuaugcugcguugcucacauucaaaccaaaccaacgacuauguuuaaugaacucaguauu

SEQ ID NO: 11202 - RNA, 62 nt, Human
ccaaaccuuagccucauuuauuuuguucuguuacauaagucauuuuccccuuagagugcuug

SEQ ID NO: 11203 - RNA, 62 nt, Human
auuauauuacuauauagccgagcuguucuuccuuccuauggaagucggaaacauggucagaa

SEQ ID NO: 11204 - RNA, 60 nt, Human
ugaaacguagucugcaacucugccucccggcaauuauacaugugucaggaugucaaaaag

SEQ ID NO: 11205 - RNA, 62 nt, Human
ggggcauggauuuacauugcaaaagguguccacaguguauuagugacauucuuucauugaca

SEQ ID NO: 11206 - RNA, 62 nt, Human
ugguucaugaggaagagaagggcaggaccagcacugauugaaaaggagggcuuguucagugu

SEQ ID NO: 11207 - RNA, 62 nt, Human
ugccaucuuuccuggaucuuguagugggugcacacgcgugcacugggaccccacacagcaau

SEQ ID NO: 11208 - RNA, 62 nt, Human
ccgggggcagggugggauggggaagaccaggagcagagucgagccucacagaagccagcgcg

SEQ ID NO: 11209 - RNA, 62 nt, Human
cagccaggccucgccagggugcggugcagagcagagcaggcaggggugggggccgggccugc

SEQ ID NO: 11210 - RNA, 62 nt, Human
augaaaccacgcugcgcuuccgaugcccccgcuugccguguaaugguucagcuaaucccaug

SEQ ID NO: 11211 - RNA, 62 nt, Human; identical to SEQ ID NO: 9620

SEQ ID NO: 11212 - RNA, 62 nt, Human
gguagccccugagaaauuuaaguucaaauuuuaauagcgauaagauaccuccuuuagugacc

SEQ ID NO: 11213 - RNA, 62 nt, Human
agaggauguuucuccucugcugggagcuguaguuucuuaucaaaauagauauuguuccacca

SEQ ID NO: 11214 - RNA, 60 nt, Human
cgacagagcgagacuccaucuaccagauccuuaugacgcagcugaugccugccuugguuc

SEQ ID NO: 11215 - RNA, 62 nt, Human
caacuaaucaucaucuucaaguuuuccaccaagguaccuacauucuaccacgccugggucca

SEQ ID NO: 11216 - RNA, 62 nt, Human
uuccaaugcuccaaugaauuuauacaugagauugauaugcaauaaaucugugugcuuuucua

SEQ ID NO: 11217 - RNA, 62 nt, Human
uuaagcaaacgguguggcauggguugaguguggccaccugcaggaugugcagggcugccuca

SEQ ID NO: 11218 - RNA, 62 nt, Human
gugcuggcugagcccccggggcagcaggagccaggcaggugaugucuuuguucucggcuccc

SEQ ID NO: 11219 - RNA, 62 nt, Human
gaguagcugggauuacaggcgccugacaccacgccccgcuaauuuuuuguauuuuuaguaga

SEQ ID NO: 11220 - RNA, 62 nt, Human
acagaaagaagaaaggaaagaaaggaaccagaggcagagagacgaggauacccagcgaaagg

SEQ ID NO: 11221 - RNA, 62 nt, Human; identical to SEQ ID NO: 11107

SEQ ID NO: 11222 - RNA, 62 nt, Human
gacaucucugggcagcucuugaguccaccuugugccagaucagcagugccacccaggcucug

SEQ ID NO: 11223 - RNA, 62 nt, Human
ucccacuuuccaagggcuccaggaaucuggggccugaccacagauuccucucccauccuuuu

SEQ ID NO: 11224 - RNA, 58 nt, Human
acccacacccucucucccugggcugugggcaggcgucacaagucccauugguggggaa

SEQ ID NO: 11225 - RNA, 62 nt, Human
aucuuuuccucuggguguuauuuuuccccacugaaugccacaccauugaaaauagacugcuc

SEQ ID NO: 11226 - RNA, 61 nt, Human
ucucuggucagcccuggagcaugggaucgugggaaagaggagggggaccaggcccagggca

SEQ ID NO: 11227 - RNA, 62 nt, Human
cugcaagcggcaucuggcggacccucaugagccugucgugcaggccaggucauuggccccuu

SEQ ID NO: 11228 - RNA, 62 nt, Human
uucuggacaagugcugagcaaugugugacccagacguacagagaggauuagcaggagguagg

SEQ ID NO: 11229 - RNA, 62 nt, Human; identical to SEQ ID NO: 9638

SEQ ID NO: 11230 - RNA, 62 nt, Human; identical to SEQ ID NO: 9639

SEQ ID NO: 11231 - RNA, 62 nt, Human
cauccuuucuuuuguauuccccuuccccuauuaccuauuagaccagaucuucuguccuaaaa

SEQ ID NO: 11232 - RNA, 62 nt, Human
ccuugcagcccagcacaccugcagguguaagggacgauuggaguuucuucccagagagucug

SEQ ID NO: 11233 - RNA, 62 nt, Human
ggucggaggcuugggaccgccagauggggccucuguuucggagacgggaccgggccgcuaga

SEQ ID NO: 11234 - RNA, 62 nt, Human
uaacacaaaucugugauaacaacaggcugugccuuauuuugauaauuuucugauucccuaga

SEQ ID NO: 11235 - RNA, 62 nt, Human
cgaguagcugggauuacaggcgccugacaccacgccccgcuaauuuuuuguauuuuuaguag

SEQ ID NO: 11236 - RNA, 62 nt, Human; identical to SEQ ID NO: 9723

SEQ ID NO: 11237 - RNA, 62 nt, Human; identical to SEQ ID NO: 11235

SEQ ID NO: 11238 - RNA, 62 nt, Human; identical to SEQ ID NO: 9723

SEQ ID NO: 11239 - RNA, 62 nt, Human; identical to SEQ ID NO: 11235

SEQ ID NO: 11240 - RNA, 62 nt, Human; identical to SEQ ID NO: 9723

SEQ ID NO: 11241 - RNA, 62 nt, Human; identical to SEQ ID NO: 11235

SEQ ID NO: 11242 - RNA, 62 nt, Human; identical to SEQ ID NO: 9723

SEQ ID NO: 11243 - RNA, 62 nt, Human; identical to SEQ ID NO: 11235

SEQ ID NO: 11244 - RNA, 62 nt, Human; identical to SEQ ID NO: 9723

SEQ ID NO: 11245 - RNA, 62 nt, Human; identical to SEQ ID NO: 11235

SEQ ID NO: 11246 - RNA, 62 nt, Human; identical to SEQ ID NO: 9723

SEQ ID NO: 11247 - RNA, 62 nt, Human; identical to SEQ ID NO: 11235

SEQ ID NO: 11248 - RNA, 62 nt, Human; identical to SEQ ID NO: 9723

SEQ ID NO: 11249 - RNA, 62 nt, Human; identical to SEQ ID NO: 11235

SEQ ID NO: 11250 - RNA, 62 nt, Human; identical to SEQ ID NO: 9723

SEQ ID NO: 11251 - RNA, 62 nt, Human; identical to SEQ ID NO: 11235

SEQ ID NO: 11252 - RNA, 62 nt, Human; identical to SEQ ID NO: 9723

SEQ ID NO: 11253 - RNA, 62 nt, Human; identical to SEQ ID NO: 11235

SEQ ID NO: 11254 - RNA, 62 nt, Human; identical to SEQ ID NO: 9723

SEQ ID NO: 11255 - RNA, 62 nt, Human; identical to SEQ ID NO: 11235

SEQ ID NO: 11256 - RNA, 62 nt, Human; identical to SEQ ID NO: 9723

SEQ ID NO: 11257 - RNA, 62 nt, Human; identical to SEQ ID NO: 11235

SEQ ID NO: 11258 - RNA, 62 nt, Human; identical to SEQ ID NO: 9723

SEQ ID NO: 11259 - RNA, 62 nt, Human; identical to SEQ ID NO: 11235

SEQ ID NO: 11260 - RNA, 62 nt, Human; identical to SEQ ID NO: 9723

SEQ ID NO: 11261 - RNA, 62 nt, Human
ucuacuaauaauacaaaauuuagcugggcaugguggcaugcaccuguaaucccacuacuagg

SEQ ID NO: 11262 - RNA, 62 nt, Human
agagcaagucuggcuaucugagauacagcugugagagccggauccggaguuaccugagggag

SEQ ID NO: 11263 - RNA, 62 nt, Human
uaucacaguuagaaggaaaugauagucaaauacacguuuagauuaaaacuaguuuaaaaaau

SEQ ID NO: 11264 - RNA, 62 nt, Human
uuuaggugccuaagcaaaaggacaggcuguccaagguagaaacuguacauagccggugaccg

SEQ ID NO: 11265 - RNA, 62 nt, Human; identical to SEQ ID NO: 9552

SEQ ID NO: 11266 - RNA, 62 nt, Human
cugguuaggaaccacagacugugacagagaagguggcgaccagcccagaagaggcccacccu

SEQ ID NO: 11267 - RNA, 62 nt, Human
cgcgcaccacagggcagcacgggagacguugacaccaccggacgagaaagaaaaaagagaga

SEQ ID NO: 11268 - RNA, 62 nt, Human; identical to SEQ ID NO: 10244

SEQ ID NO: 11269 - RNA, 62 nt, Human
cggggguagggguggggccacacaaaucuccaggagccaccacucaacacaauggcccugcc

SEQ ID NO: 11270 - RNA, 62 nt, Human
ggcccagccagcuucagaucuggucuuggcgagcucucgccaggaccccaaggcuguugguc

SEQ ID NO: 11271 - RNA, 62 nt, Human
ccccagcgcugcugguagccaggggaggggucugcacagcgagaaguacugugaugacuuug

SEQ ID NO: 11272 - RNA, 62 nt, Human
cugugcuucagcucuucuugacaucaaggcucuuccguuccacauccacacagccaauccaa

SEQ ID NO: 11273 - RNA, 62 nt, Human
ggagaucaugggagacguccugcacaagucccugcaacuggacgugcagaucgccucggagc

SEQ ID NO: 11274 - RNA, 62 nt, Human
ugagacuguaccucuaaauaaccaaaaccuugauuacagccaugggguggggguggggguca

SEQ ID NO: 11275 - RNA, 62 nt, Human
gcccagcucucgauacguuuggucuuucaugcugaaaaauaaauaauaaagccugucccgug

SEQ ID NO: 11276 - RNA, 62 nt, Human
ccgguccaagccuguggcuggagcugguguguguuuaucuaauaaagucccacaggugccuc

SEQ ID NO: 11277 - RNA, 62 nt, Human; identical to SEQ ID NO: 9336

SEQ ID NO: 11278 - RNA, 62 nt, Human
cccugugaacagguauuuucaggacucaaacuaccacaaugaacagaguauagauuuuagau

SEQ ID NO: 11279 - RNA, 62 nt, Human
aaaguaacuguuuuuccccuugcuucaggugcugucgggguauggaggguuuuagacucuca

SEQ ID NO: 11280 - RNA, 60 nt, Human
cgucaaaaacucaccauggaccccaaggcagaaaccaagaacugucugcaggcaaauaag

SEQ ID NO: 11281 - RNA, 62 nt, Human
aaaguaguugauuacgagggagucaaauuuucuuuuuaaaaaggagcuucaaugauuuguaa

SEQ ID NO: 11282 - RNA, 62 nt, Human
uuaagaagguucuuugucauucuccccacccuugagaauguacuuugugagauccauccccu

SEQ ID NO: 11283 - RNA, 62 nt, Human
ucuacuucuuccugugugggagcccauagcuguugucuaacagguaagaaaugaaauugaac

SEQ ID NO: 11284 - RNA, 55 nt, Human
cccaaggcagaaaccaagaacugucugcaggcaaauaagcacccagcacccaucc

SEQ ID NO: 11285 - RNA, 62 nt, Human
aacuaccaugauugcuuuugagggcccggaauuauaaauauauauuauauuuuaauuguuug

SEQ ID NO: 11286 - RNA, 62 nt, Human
gaauauuuugcacuuuugauacucuuaggaacaaauaacuuauuuggcaaauuguuucuuuu

SEQ ID NO: 11287 - RNA, 62 nt, Human
gugcauguauuuuucaaagauaaagaaaguguacugcgaaaauaugcaggaagauuaauuuu

SEQ ID NO: 11288 - RNA, 62 nt, Human
cccugugagcugagcugguuaggaaccacagacugugacagagaagguggcgaccagcccag

SEQ ID NO: 11289 - RNA, 62 nt, Human
uggggaucauuucuauguguguggguaaucuggucaguaagauugagacuuaguuaagauuc

SEQ ID NO: 11290 - RNA, 62 nt, Human
ccccuuagagugcuugaagaaaugccaccuacagguuguguacuuuucauaaugguuuccau

SEQ ID NO: 11291 - RNA, 62 nt, Human
aaguuccagagugcuauaaucuagauguaauguugucacuaauuaauugccauuacucccag

SEQ ID NO: 11292 - RNA, 62 nt, Human
agauaauauguuuuuuccuacuucaacagaagaacaauauaaaauuaauaucuauuaccaag

SEQ ID NO: 11293 - RNA, 62 nt, Human
uuugacaguauguugucuguaggcagauauucuuucgucauagccuguaaauggugucauug

SEQ ID NO: 11294 - RNA, 60 nt, Human
gcaggugugugguaaacggguaaugcaugggaaauaaugagaagcagcucacagaguuua

SEQ ID NO: 11295 - RNA, 62 nt, Human; identical to SEQ ID NO: 10250

SEQ ID NO: 11296 - RNA, 62 nt, Human
aggaggggagauuuuuuugugacuaccaugacaucguagggacagugccacuggaggaguca

SEQ ID NO: 11297 - RNA, 62 nt, Human
gcaccuagcauuucagcagauuuaaagccagaauuacggcuauaaauauuugggguuuuggu

SEQ ID NO: 11298 - RNA, 62 nt, Human
uccgccauauuucuucagccuuucuucucgaucacccguguauucuuugaccaguaaaugac

SEQ ID NO: 11299 - RNA, 62 nt, Human
auuaagucauuuuguaauauuugaauuuuuacauuuguuguacaaucaggaaaagcaauaaa

SEQ ID NO: 11300 - RNA, 52 nt, Human
gaugaugauaaugaugaugacgacgacaacgaugaugcuuguaacaagaaaa

SEQ ID NO: 11301 - RNA, 62 nt, Human; identical to SEQ ID NO: 10250

SEQ ID NO: 11302 - RNA, 62 nt, Human
gugugacccagacguacagagaggauuagcaggagguagggacugcagguagggccuguuau

SEQ ID NO: 11303 - RNA, 62 nt, Human
cccuacaacugagcacaaccucuuuccccacagugcaauucagaauaugcucagggaaugcc

SEQ ID NO: 11304 - RNA, 62 nt, Human
ccuggugucagagucguaauuuaaagcguguguguauauggacuuugucccuuaaggucgau

SEQ ID NO: 11305 - RNA, 62 nt, Human; identical to SEQ ID NO: 11053

SEQ ID NO: 11306 - RNA, 62 nt, Human
cuugccaguucuucagcucuaggacuuguagcuuuaagcaaacgguguggcauggguugagu

SEQ ID NO: 11307 - RNA, 62 nt, Human; identical to SEQ ID NO: 10777

SEQ ID NO: 11308 - RNA, 62 nt, Human; identical to SEQ ID NO: 10778

SEQ ID NO: 11309 - RNA, 62 nt, Human
ccuuuuauaccagagaccugcugugagguaacugggaucgcaggcauuuuccucgccuaggc

SEQ ID NO: 11310 - RNA, 57 nt, Human
gcaacuccaccuggacugaugggcacaggaggcaccaauagcgauuauugggggcaa

SEQ ID NO: 11311 - RNA, 62 nt, Human
guauccguagcuaucaggaucauugcgcacucauauaugcuaagccuucuguucucuaauag

SEQ ID NO: 11312 - RNA, 60 nt, Human
gagcaaggccugcgagggaggaacgggccgcuccccgccagccgccuuccccagcagccg

SEQ ID NO: 11313 - RNA, 62 nt, Human
ucaucccacuuccucagcccguuuccagccacuuuccucgaauccaguguccagcaacagac

SEQ ID NO: 11314 - RNA, 62 nt, Human; identical to SEQ ID NO: 10508

SEQ ID NO: 11315 - RNA, 62 nt, Human
auuaaagcaacugagugucuagcccuaaauuaaccagguaaaaacuguuaacacuaaccuga

SEQ ID NO: 11316 - RNA, 61 nt, Human
cgguuucaacacacacagacaaacacagccacacgcgcacacaaguauaagacuuuuugua

SEQ ID NO: 11317 - RNA, 62 nt, Human
ugagccaagaucgcaccauugcacuccagccuggaugauagagugagacuguaccucuaaau

SEQ ID NO: 11318 - RNA, 60 nt, Human
aagaaaaugugacuucaaaggaaaggaacaaauuuucaaagacuugggggagugaaggca

SEQ ID NO: 11319 - RNA, 62 nt, Human; identical to SEQ ID NO: 9677

SEQ ID NO: 11320 - RNA, 61 nt, Human
gugugauugucuucuguuaucauuugucuuacaggcggcuauugcagacggcuaauuuaug

SEQ ID NO: 11321 - RNA, 62 nt, Human
ugaaaaauaugccauuucauaaagucugaggauuuucgucaaccuuacugaaacacacuggu

SEQ ID NO: 11322 - RNA, 58 nt, Human
caaggacccaggucuuccugcugcugccagggagagcagggacagugccgcgugcgag

SEQ ID NO: 11323 - RNA, 62 nt, Human
aaggguguuugcgcacucugaucaacuggaaccucuguaucaugcggcugaauucccuuuuu

SEQ ID NO: 11324 - RNA, 61 nt, Human
gggcugcccacagccuuuucaggggcucgcuuggcgggugacggggccgcagccaggccuu

SEQ ID NO: 11325 - RNA, 62 nt, Human
ugccagcucuguucugauucaccagggguccgucaguagucauugccacccgcggggcaccu

SEQ ID NO: 11326 - RNA, 62 nt, Human
caggauccacagcuuaaagaugggaauucagguaugaaagaaaacaggcaaggaggcacuga

SEQ ID NO: 11327 - RNA, 62 nt, Human; identical to SEQ ID NO: 9795

SEQ ID NO: 11328 - RNA, 55 nt, Human
caucucccaaacucucucuuaauugcgauaauucacagaacauaaaauucacgau

SEQ ID NO: 11329 - RNA, 62 nt, Human
acccagugaaaugcugugucccuucucccccgugccccuugaugcccccuccccacagugcu

SEQ ID NO: 11330 - RNA, 61 nt, Human
cugcacagcccagcccagcccaaggcccccaggagcugggacucugcuacacccagugaaa

SEQ ID NO: 11331 - RNA, 62 nt, Human
cuacacagacugcagcaacgguugcaucugcauauccuaagaggaaaaaaugaccuucaaga

SEQ ID NO: 11332 - RNA, 61 nt, Human
cuccguagccccugcacggcaccaguuccccgagggacgcagcaggccgccucccgcagcg

SEQ ID NO: 11333 - RNA, 62 nt, Human
acgcccgcccggaacaagaacaagaagaggagaccgucggcaagugggauuugaaaugcagc

SEQ ID NO: 11334 - RNA, 62 nt, Human
gauuuuuuugggaaguuaauuucuaacuucuuucacugauaaaugaagaaaaguauugcacc

SEQ ID NO: 11335 - RNA, 62 nt, Human
ggguggucucaaucuccugaccucgugauccacccaccucgaccucccaaagugcugagauu

SEQ ID NO: 11336 - RNA, 61 nt, Human; identical to SEQ ID NO: 11324

SEQ ID NO: 11337 - RNA, 62 nt, Human
gagcuggcccuugacccccacccacccccacccuugcuggcaggggcagggaccccaggggg

SEQ ID NO: 11338 - RNA, 60 nt, Human
ugcuaccaguuccauaugaugagaaauaaacguucgcugagguuuuguuucauacucccu

SEQ ID NO: 11339 - RNA, 62 nt, Human; identical to SEQ ID NO: 11337

SEQ ID NO: 11340 - RNA, 60 nt, Human; identical to SEQ ID NO: 11338

SEQ ID NO: 11341 - RNA, 62 nt, Human
agcaucgagugacacugggccauccaggcggcucugcucccaccagacaggagcuaggccuc

SEQ ID NO: 11342 - RNA, 60 nt, Human
guccuuccucacccacaggcgugugucacuguggcugggacggcagcgcucagaggagcc

SEQ ID NO: 11343 - RNA, 62 nt, Human
guuucccagacccagaaagcuuuacagaaaaucauuguaagacaauuuauuaauuugagaaa

SEQ ID NO: 11344 - RNA, 61 nt, Human
ggcaauggagugaguuucccaacuaagaaaccacuauuauauauuuuuucccuucagucac

SEQ ID NO: 11345 - RNA, 62 nt, Human
cagugaaggcguuugugaggucuuucuggucccagcaugaaauaaagccuuggccugggggc

SEQ ID NO: 11346 - RNA, 60 nt, Human
uuccccuggacuguccucugacccuuuggcucauccuagauugcaguguguccuguggac

SEQ ID NO: 11347 - RNA, 62 nt, Human; identical to SEQ ID NO: 9563

SEQ ID NO: 11348 - RNA, 62 nt, Human
agauguuuuggggaaaguuggagaagccguggccuugcgagaggugguuacaccagaaccug

SEQ ID NO: 11349 - RNA, 62 nt, Human
cugacuggaacuggcucccuccccaucagcucccagcugucacucucucccacccccgggca

SEQ ID NO: 11350 - RNA, 62 nt, Human
gaagaacucugcucgagggcagggugcccuggaacacugguaguucuggggcugggagggag

SEQ ID NO: 11351 - RNA, 62 nt, Human
gcauggaagcccacgugugcacuuaggggcccauaaauggcagaagggccccuccuuuggga

SEQ ID NO: 11352 - RNA, 60 nt, Human
aaaauuuguugcucagguguugcacaauuuuuaucuaacacugaggcuaucagcuccaac

SEQ ID NO: 11353 - RNA, 62 nt, Human
gcuuuaaaauggcaguguuucucccacuuugauaugcuaacauuuaguaagcacuggcuuua

SEQ ID NO: 11354 - RNA, 62 nt, Human
ucuaaacuucccccaugucagucagaugaaguuacuacuauauuucaccacccugcagguaa

SEQ ID NO: 11355 - RNA, 62 nt, Human
aggcuaaagcugcuggcccggggcccacaggaggggcuucgaggcuggcccugccaggcagu

SEQ ID NO: 11356 - RNA, 56 nt, Human
ccuugacgggcacagccagaagcugcaccuggccgagaacgccgagccugaggagc

SEQ ID NO: 11357 - RNA, 62 nt, Human
gguaguggucacugcggucugggagugcucagauagcccgcagaacaaaucaugucaccaag

SEQ ID NO: 11358 - RNA, 62 nt, Human
ccaagauaagccugagccuuagcucccagcuagggggcguuauuuauggaccacuuuuauuu

SEQ ID NO: 11359 - RNA, 62 nt, Human
ugggcccugccucggccuccugcgccaauacugugacuuccaaacaauguuacugcugggca

SEQ ID NO: 11360 - RNA, 62 nt, Human
gugauccuagcuacucaggaggcugaggugggaggaucgcuagagcccagagagccaaggcu

SEQ ID NO: 11361 - RNA, 62 nt, Human
gggaggucguucuagggaugcuccugaccuccgucucuuggaccuaagauggaauguguccc

SEQ ID NO: 11362 - RNA, 62 nt, Human
ugggugauaauugagagcgucagacccaggacuguucagggaggagccccggucagacuccc

SEQ ID NO: 11363 - RNA, 62 nt, Human
aguaagccaagaucgugccauugcacuccagccugggugacagagcgagacuccaucucaaa

SEQ ID NO: 11364 - RNA, 61 nt, Human
gacccuuuaacuguauccuuaaccaccgcauaugcaugccaggcugggcacggcuccgagg

SEQ ID NO: 11365 - RNA, 62 nt, Human
ggccguggaggggguccuagcuccgcugcauucugcaucccaagugggcacguggaggaagg

SEQ ID NO: 11366 - RNA, 62 nt, Human
cccugccauuuaggugccuaagcaaaaggacaggcuguccaagguagaaacuguacauagcc

SEQ ID NO: 11367 - RNA, 62 nt, Human
gggaugacucccaguccacauggaaaacaucagggagugacaauccagcaagaaaucccucg

SEQ ID NO: 11368 - RNA, 62 nt, Human
cucaggaggaauuccugcggguccucggcuccaugugccagaggcuccgguccaugcaguac

SEQ ID NO: 11369 - RNA, 62 nt, Human
cuacuaaugugcagccauugcccaagcagugacugcguugcauacauuuggcacugaguagg

SEQ ID NO: 11370 - RNA, 61 nt, Human
ugccuuguuugccccucagcgugccaggcagacugggggcaggacagccggaagcugagac

SEQ ID NO: 11371 - RNA, 62 nt, Human
aguaaacuagaaguccaggguugcuugguuuacugguuuauaagaaaucugaaagcaccucu

SEQ ID NO: 11372 - RNA, 59 nt, Human
uaagcacccagcacccauccuggcugccggugccccguacccuguauuuauucuuuuaa

SEQ ID NO: 11373 - RNA, 62 nt, Human
gguaacaagacuccaccacugaguggcaccugcccuauugcaaaggaauccaguuccuccgg

SEQ ID NO: 11374 - RNA, 60 nt, Human
cuggcgcccaugaugggagggauugacauguuucaacaaaauaaugcacuuccuuaccua

SEQ ID NO: 11375 - RNA, 62 nt, Human; identical to SEQ ID NO: 10777

SEQ ID NO: 11376 - RNA, 62 nt, Human; identical to SEQ ID NO: 10778

SEQ ID NO: 11377 - RNA, 62 nt, Human
ucauugaauuaucacaacgaccuuuucaaguaggcauuaucaccaugcgacagguugaggac

SEQ ID NO: 11378 - RNA, 54 nt, Human
uugagaauacaugagggaguuacucuugcauggaugguuguaaagaaacaauca

SEQ ID NO: 11379 - RNA, 62 nt, Human
gagguccagcuagaaaaaguggcaguuuuaaccaccaacguagaagcuuuuuuuuccccaca

SEQ ID NO: 11380 - RNA, 62 nt, Human
ucuauuuaagcaugugguuuuaaaaauagacaguauuuuuuaaaaaucaaaaaaugacuugc

SEQ ID NO: 11381 - RNA, 62 nt, Human
gacaugcgagcuuccagagugcaaucuaugugaugucuuccaacguuaauaaaucacacagc

SEQ ID NO: 11382 - RNA, 58 nt, Human
caggucuguuucccagacccagaaagcuuuacagaaaaucauuguaagacaauuuauu

SEQ ID NO: 11383 - RNA, 62 nt, Human
ggccuuacccccaugaaguauuacuguuaacauauguucggacugcuucccuucaccaaugu

SEQ ID NO: 11384 - RNA, 62 nt, Human
cucaugacacuguuuggccuuucuuggggagaaggcgggguauucccacucaccagcccuag

SEQ ID NO: 11385 - RNA, 62 nt, Human
uaagcauuuaauucaaagagaggggagcauccauuauugauacaugugggcuuuuaaaaacu

SEQ ID NO: 11386 - RNA, 62 nt, Human
cgcgggaagcuggcccaggucagguccgcaaaggcuucugaagaagaggaagggcgaguagg

SEQ ID NO: 11387 - RNA, 62 nt, Human
uagaucucaggguacaaugauuaaacguacuuuguuuuucgaaguuaaauuuacagcuaaug

SEQ ID NO: 11388 - RNA, 60 nt, Human
aauuuuauaaguuuuguuacaugaaagguugaaauauugagugguugaaagugaacugcu

SEQ ID NO: 11389 - RNA, 62 nt, Human
uaaaguaacaucagccauuuuuagauugguucuguuuucguaccuucccacuggccucaagu

SEQ ID NO: 11390 - RNA, 56 nt, Human
aaaaaauuagccggccgugguggcaagugccugaaaucccagguacucaggaggcu

SEQ ID NO: 11391 - RNA, 62 nt, Human
gggcauucuuucuacauagaaguuuuuauuagacuacgaugaucucuggcauuuuuuucuac

SEQ ID NO: 11392 - RNA, 62 nt, Human
uuaaguauuggaauuucacaaaagacauaggacuuaacuggaaaaugaaaaaaaaaagaaaa

SEQ ID NO: 11393 - RNA, 62 nt, Human
cuuccaucauaaaucaguccauuuguuuacaacuguguuccaagcagguuucauaaagaaau

SEQ ID NO: 11394 - RNA, 62 nt, Human; identical to SEQ ID NO: 10270

SEQ ID NO: 11395 - RNA, 62 nt, Human
uuagacaggcuggccugccgguuccacaggguacaguuaggacuugagucuuucuuuuucug

SEQ ID NO: 11396 - RNA, 60 nt, Human
uggugagugagugauaggguaacaugggccuucaggaugaccccuuggaacugugccgag

SEQ ID NO: 11397 - RNA, 62 nt, Human
gaaauuaugugauacacugaaaugacuuuuguuuuucuucuaacucauacaaaacugguuug

SEQ ID NO: 11398 - RNA, 62 nt, Human
auggccugcuuuuuaccucagagaaccuaaaacuagugcacauugucugccauaagaaaacc

SEQ ID NO: 11399 - RNA, 62 nt, Human
ccgcaccggcuuuccugcugcagaucugggcugcgguggccagggccgugagucccguggca

SEQ ID NO: 11400 - RNA, 62 nt, Human
ggggggcgcggggagugaccaggcgggggccucaccgccccagggccguugccugcucagac

SEQ ID NO: 11401 - RNA, 62 nt, Human
cacgagggaugcugagcccuggugucagagucguaauuuaaagcguguguguauauggacuu

SEQ ID NO: 11402 - RNA, 62 nt, Human
augcauuuuagcuuugagcuuuuggggguuauucuaccaacaaacaguccauuggaaagaaa

SEQ ID NO: 11403 - RNA, 62 nt, Human
uaagcacauggggcucccuuagaacuuacuccacugauuuaaaaaaaaaaaacugccuggca

SEQ ID NO: 11404 - RNA, 62 nt, Human
cuuuuucuaugucaaauguaacguuuauuuuuuuaaacaauaaaauugauuugccaaaaucc

SEQ ID NO: 11405 - RNA, 62 nt, Human; identical to SEQ ID NO: 11403

SEQ ID NO: 11406 - RNA, 62 nt, Human; identical to SEQ ID NO: 11404

SEQ ID NO: 11407 - RNA, 62 nt, Human
aagaccgggccccaaguggcaagggcuggccuggggcgggcagcuuggguccuggacguuga

SEQ ID NO: 11408 - RNA, 62 nt, Human; identical to SEQ ID NO: 9296

SEQ ID NO: 11409 - RNA, 62 nt, Human; identical to SEQ ID NO: 11407

SEQ ID NO: 11410 - RNA, 62 nt, Human; identical to SEQ ID NO: 9296

SEQ ID NO: 11411 - RNA, 62 nt, Human; identical to SEQ ID NO: 9594

SEQ ID NO: 11412 - RNA, 62 nt, Human; identical to SEQ ID NO: 9503

SEQ ID NO: 11413 - RNA, 62 nt, Human
uuuugaaaucugcagguuuuuaaugucuuguggaaauuugcagaggggcaggugugugguaa

SEQ ID NO: 11414 - RNA, 60 nt, Human
uuuaucaccuccuuaucaacccuaucuaucuccaaauacaguccauauugggaauuaggg

SEQ ID NO: 11415 - RNA, 62 nt, Human; identical to SEQ ID NO: 9608

SEQ ID NO: 11416 - RNA, 62 nt, Human; identical to SEQ ID NO: 9609

SEQ ID NO: 11417 - RNA, 62 nt, Human
aaggaacucuuuuuuuguaaaucacggacaccucaauuagcaagaacugaggggagggcuuu

SEQ ID NO: 11418 - RNA, 61 nt, Human
guggaccgaaccguccccccaggaacacaccuucagguagaccccgaagccucaaggccgg

SEQ ID NO: 11419 - RNA, 62 nt, Human
cugauaauuaugcaagcaacaauucuguagccucaaguaagaccaccugugaacuugaucau

SEQ ID NO: 11420 - RNA, 61 nt, Human
caaugauagcaaauaauguacgaauguuuuuugcauucaaaggacauccacaucuguugga

SEQ ID NO: 11421 - RNA, 62 nt, Human
gagagccgcccuuaccguuggucuccggaucccccagucccaucccgccguuuucggcuguc

SEQ ID NO: 11422 - RNA, 55 nt, Human
gccugccgguuccacaggguacaguuaggacuugagucuuucuuuuucuguuuug

SEQ ID NO: 11423 - RNA, 62 nt, Human
gccgccucccucucuugggacgcaacuucuuccccacucggaugggcuuuaaauuauuccca

SEQ ID NO: 11424 - RNA, 62 nt, Human
ccugacaaaggcagcacuuauuuccugggcuggugcgccccaaaacacggccccgacacuua

SEQ ID NO: 11425 - RNA, 62 nt, Human
accuggcuaaggaguuuaaaguguauccaagaggacgugggagccacugaugguucaugagg

SEQ ID NO: 11426 - RNA, 60 nt, Human
gggcauggagccagugccugugguuguuucuccagagucaaaagggaagucgagggaugg

SEQ ID NO: 11427 - RNA, 62 nt, Human
gugggcccuuauugcagcugucucacagccugagcugugguacagagaaauggggguucucc

SEQ ID NO: 11428 - RNA, 60 nt, Human
acuacacaguggaaaacagacaagcggccccuuccccaaaucccaagagugucuugcugc

SEQ ID NO: 11429 - RNA, 62 nt, Human
uauccagggugcucuguuuccccaccguucccagguguacgaggcagagggccgggacagcu

SEQ ID NO: 11430 - RNA, 59 nt, Human
agagacggucuggaaggaaacacgcggaucugaacagcaguaauccugggggauacggg

SEQ ID NO: 11431 - RNA, 62 nt, Human
uggugucuuuggaaggaagguagauacaaaaagauugugguaaaaacuggggucagugcucu

SEQ ID NO: 11432 - RNA, 60 nt, Human
uuggucaccccggccaggccccggaagcagcagccagggaugguccuuccucacccacag

SEQ ID NO: 11433 - RNA, 62 nt, Human
ccaugaguuuggggagcgagaccccaccugagacaggcaguaggagccugugcugaccuugg

SEQ ID NO: 11434 - RNA, 62 nt, Human
aaaccagaaacagaaaagaaaugacgacccaagaccccccuacaagcauacuucuuuugcgu

SEQ ID NO: 11435 - RNA, 62 nt, Human
cagagcccgagggaugaucuagccugauuccugcguguccgaaagaacuuaacguuuuaaag

SEQ ID NO: 11436 - RNA, 56 nt, Human
uuucuuagugccucugugcauuugggugauguucuauuuacauggccuguguaaau

SEQ ID NO: 11437 - RNA, 62 nt, Human
uuuucuaauguaguuagaaguuucauugucugauggacacaauaugcccuuccgguucuauu

SEQ ID NO: 11438 - RNA, 62 nt, Human
gccugaaccaagaggccaggagcccccaugggccgcccaguaccaugcacacuccugucccg

SEQ ID NO: 11439 - RNA, 62 nt, Human
gcaggagggggugggaaugcaggccaggaggacgugguaggagggggagucugccagaggag

SEQ ID NO: 11440 - RNA, 57 nt, Human
uauuacacacaugugcgcauuacacacacacaauacacauacaugcauauagacgca

SEQ ID NO: 11441 - RNA, 62 nt, Human
ggggugucugcaugucccuucacauaauugauaaugguaccaccuucuauaauaauaauaua

SEQ ID NO: 11442 - RNA, 60 nt, Human
aaaaauuuuuuucccuuucagucauugucuuauaugcuuagcauagauuugcagcucagu

SEQ ID NO: 11443 - RNA, 62 nt, Human
ccuaacaggcccagagcagagccccuuaccucccaggucagacuaccugcucaggcccuccc

SEQ ID NO: 11444 - RNA, 60 nt, Human
agucauguugcuacuaaaaguagggcauaugaccgccuaagaaacagaacuucgagaagu

SEQ ID NO: 11445 - RNA, 62 nt, Human
cccaugcuccgugugucugugucugcauguccacacgucugaugcaccuguguacguguguc

SEQ ID NO: 11446 - RNA, 61 nt, Human
ccgccacgccgccgucgaugccagcgcuguccccacggguaccaggaagugcagagccgca

SEQ ID NO: 11447 - RNA, 62 nt, Human
cgcccggcuccgccccugcagcccacacagcacaacgucuuaccgugccuauuaccaagcga

SEQ ID NO: 11448 - RNA, 62 nt, Human
aaugauggcaagcccaguuucuccugagcauucagacccccaggccccagcacuuggcguuu

SEQ ID NO: 11449 - RNA, 62 nt, Human
cuucgcugcuuucccaaacuccugcagcccuccugaguccgacuuccguugauagcaaggca

SEQ ID NO: 11450 - RNA, 60 nt, Human
cggcgaaugagcugggugggugcccaggagccggcccgcagcaccugcacacacgaaguc

SEQ ID NO: 11451 - RNA, 62 nt, Human; identical to SEQ ID NO: 9955

SEQ ID NO: 11452 - RNA, 56 nt, Human; identical to SEQ ID NO: 9956

SEQ ID NO: 11453 - RNA, 62 nt, Human
ggaaggucuucaaagcacaucgaaauguauuauucgcuaguagcggcuacuuuaaaaugcuu

SEQ ID NO: 11454 - RNA, 62 nt, Human
gaaagauacagggaacaaaaaucaauuuguacagucuuaauauuaaaagcagcuugacuaaa

SEQ ID NO: 11455 - RNA, 62 nt, Human
uagcgcuugccuagguugcugaaaacagggaggcaccugguaucucgagugccugcaguugc

SEQ ID NO: 11456 - RNA, 61 nt, Human
acuguagaauacaacaauaaaauacagccauguaccacauaacaacaucuugguaaacaac

SEQ ID NO: 11457 - RNA, 62 nt, Human
ucccauuuacucuugagacuacuucaauuaguuccccuacuacacuuugcuagugaaacugc

SEQ ID NO: 11458 - RNA, 62 nt, Human
cuuugaaggagaaucaucauuguugcuuuaucacuucuaagacauuuuguacggcacggaca

SEQ ID NO: 11459 - RNA, 62 nt, Human; identical to SEQ ID NO: 11361

SEQ ID NO: 11460 - RNA, 60 nt, Human
acuguaauuacagcacacagauugcaaguauugcguaccaagugauacaacucgaaaugc

SEQ ID NO: 11461 - RNA, 62 nt, Human
ucuaguauguuucugugucaaucgcugugaaauaaagucugaaaacuuuaaaagcauugcuu

SEQ ID NO: 11462 - RNA, 62 nt, Human
gccaccuacagguuguguacuuuucauaaugguuuccaugaauguaguacguucauacaggc

SEQ ID NO: 11463 - RNA, 62 nt, Human
gguccaagccuguggcuggagcugguguguguuuaucuaauaaagucccacaggugccucac

SEQ ID NO: 11464 - RNA, 60 nt, Human
cuccgcaccuuccacuugcucucuggaucaggcagauauaaacuuucuagcgcauuuuga

SEQ ID NO: 11465 - RNA, 62 nt, Human
cuaugacaugagcacacccaacgcaccccugcacuacuaugagaccguucgcauggcagcca

SEQ ID NO: 11466 - RNA, 61 nt, Human
cauaugauuuuuuuuuuucauuuaaguguuggaagaugcuaccuaacagccacguucacau

SEQ ID NO: 11467 - RNA, 62 nt, Human
cagucaggguacuaagcaugggugggaacuccugccuuauaaaaauuguuuuuguguucuua

SEQ ID NO: 11468 - RNA, 62 nt, Human
caugagaaaagugaggcucagaaagguauaguaacuuacucaaggucacgcagauagugaau

SEQ ID NO: 11469 - RNA, 62 nt, Human
gggaacucuucuccucgcgggggacuugggauggccaucagaccuucuagggucuggcuggg

SEQ ID NO: 11470 - RNA, 62 nt, Human
auucacaguguaaauuuaauccaaacugaaauuuuguuucaacugaauuuguaauuaacucu

SEQ ID NO: 11471 - RNA, 62 nt, Human
ggccagggccuuacggggcuggguuccuguguggggcguggagcuggggcugaaguggaggg

SEQ ID NO: 11472 - RNA, 62 nt, Human
cuaccuuacuguguugaaacgggacaaaugcaauagaacgcauuggguggugugugucugau

SEQ ID NO: 11473 - RNA, 62 nt, Human
uccuggaguuaaauuuuccaacagccauguugaggaauagcacucugcauguuuuuguuuug

SEQ ID NO: 11474 - RNA, 59 nt, Human
cggccucucagaagagccucuacugaaaaauauggaucaucacagauccaaacagaaaa

SEQ ID NO: 11475 - RNA, 62 nt, Human
augagaguugucccuuagccuuauaaacuccccaugaucugacaugcagaaauccagccuug

SEQ ID NO: 11476 - RNA, 58 nt, Human
ccacgugaaacugcuguuuucuaggccaaaaauggugagcgaucauuuauuucaugau

SEQ ID NO: 11477 - RNA, 62 nt, Human
guaguggcaguaauaaagugggaccauuuuuuccaaaugcgacauuguuucugauguuuuuu

SEQ ID NO: 11478 - RNA, 54 nt, Human
acacagcacaacgucuuaccgugccuauuaccaagcgaguguuuguaaccaugu

SEQ ID NO: 11479 - RNA, 62 nt, Human
uaauccaggaagugucccggaaaagagagagaagacaucagagccuaaaggaaacagcuggg

SEQ ID NO: 11480 - RNA, 60 nt, Human
ucaggcaauucucgugccuaagccucccgaguagcugcgacuacaggcgccggccagcau

SEQ ID NO: 11481 - RNA, 62 nt, Human
cuguggcuguuccuuauccuaaugaugcgcuuuugucccguaaauguuaacacucaugaagc

SEQ ID NO: 11482 - RNA, 62 nt, Human
cacacaauacacauacaugcauauagacgcaucuauuggaaaugcaguuccacaggugagca

SEQ ID NO: 11483 - RNA, 62 nt, Human
ccuuucaagucucauuuuguuucuaacugagaacucuauggaugaugaucucaaaaagccuu

SEQ ID NO: 11484 - RNA, 60 nt, Human; identical to SEQ ID NO: 10008

SEQ ID NO: 11485 - RNA, 62 nt, Human
ggugccugaggguggggugggauuugcagggucauuaucagaacaugaggauaacuuccuug

SEQ ID NO: 11486 - RNA, 55 nt, Human
gggugauggcucuggggagcggcugccauccuacaagccacacccccuccucuga

SEQ ID NO: 11487 - RNA, 62 nt, Human
uguucuuuggggguuuuguuuacaaacuucuuuuuguauugagagaaaaauagccaaagcau

SEQ ID NO: 11488 - RNA, 61 nt, Human
gucuaauuuacagggauauuuaauuuugucaggucuauguauauuuauccagcuauacuua

SEQ ID NO: 11489 - RNA, 62 nt, Human; identical to SEQ ID NO: 11487

SEQ ID NO: 11490 - RNA, 61 nt, Human; identical to SEQ ID NO: 11488

SEQ ID NO: 11491 - RNA, 62 nt, Human
ucggaugcaaaacaaaaaauuuuaaaagaaaaugugacuucaaaggaaaggaacaaauuuuc

SEQ ID NO: 11492 - RNA, 62 nt, Human
caagacuccaccacugaguggcaccugcccuauugcaaaggaauccaguuccuccggaauaa

SEQ ID NO: 11493 - RNA, 62 nt, Human
uugcuuugauaucaucaacugcagagaaugcuguugaugggaaugcuggaagcagaaacuuu

SEQ ID NO: 11494 - RNA, 60 nt, Human
aaucccagcucugccuuugaagcacuuguggccaccgucaagucccuuugcucucggacc

SEQ ID NO: 11495 - RNA, 62 nt, Human
guggaagcuaaucacuggcaggagccuggauggcuggcggaaagauauaugagaaagaaaaa

SEQ ID NO: 11496 - RNA, 62 nt, Human
uagaaaaucuggccauuuuauguguuauuuuuuuccugcauaccagugcccccuggaaagau

SEQ ID NO: 11497 - RNA, 62 nt, Human; identical to SEQ ID NO: 11232

SEQ ID NO: 11498 - RNA, 62 nt, Human
gugaguugggcacucccuguuguugguuuuccuuuugcagcacacugggcagucucccuaua

SEQ ID NO: 11499 - RNA, 62 nt, Human
caggagcugggaguugagaccuccagggaagucucguccggauccaucgcucuucucucaag

SEQ ID NO: 11500 - RNA, 62 nt, Human
aacuuguaucgguucuuaauuaaauuauccaaaacggaggcauuuaaacacuuggauuuaca

SEQ ID NO: 11501 - RNA, 62 nt, Human
uguagaauacaacaauaaaauacagccauguaccacauaacaacaucuugguaaacaacaga

SEQ ID NO: 11502 - RNA, 62 nt, Human
gcugacucucuuuuugaacucagcccgccugcacccaggugaaauaaacagccuuguugcuc

SEQ ID NO: 11503 - RNA, 62 nt, Human
ccacgauuccacagaccaggacauuccaugugccucauggcacugccaccuggcccuuugcc

SEQ ID NO: 11504 - RNA, 62 nt, Human
ugucucaagucaaauggauucaucaccugucaugcauugacaccugauacccagacuuaauu

SEQ ID NO: 11505 - RNA, 62 nt, Human
aaccacuagccuaauagaccagcacggucaacuagaaugacaaacauuagcuacugggaacu

SEQ ID NO: 11506 - RNA, 62 nt, Human
uagagaaauauuuaaauuuuuagaagcaaaacuuauacaacauuaaaaugauaccaaguccc

SEQ ID NO: 11507 - RNA, 62 nt, Human
cuuuuuaaaaaggagcuucaaugauuuguaacugaaauaucagguucuagaagaaacuggcg

SEQ ID NO: 11508 - RNA, 60 nt, Human
ucaaauuuucuuuuuaaaaaggagcuucaaugauuuguaacugaaauaucagguucuaga

SEQ ID NO: 11509 - RNA, 62 nt, Human
accccuguauaucuuagcagcacugaguccagugcgagcacacacccacuauacaagagugg

SEQ ID NO: 11510 - RNA, 60 nt, Human
acagggggagguagggcuuuggagacagagggucgucccagccgccagugguccaaggag

SEQ ID NO: 11511 - RNA, 62 nt, Human; identical to SEQ ID NO: 11509

SEQ ID NO: 11512 - RNA, 60 nt, Human; identical to SEQ ID NO: 11510

SEQ ID NO: 11513 - RNA, 62 nt, Human
ggccucacguaacuuuacugcagccgagguccaggccguggaggggguccuagcuccgcugc

SEQ ID NO: 11514 - RNA, 60 nt, Human
cagauggggccucuguuucggagacgggaccgggccgcuagaugggcauggggugggccu

SEQ ID NO: 11515 - RNA, 62 nt, Human; identical to SEQ ID NO: 11513

SEQ ID NO: 11516 - RNA, 60 nt, Human; identical to SEQ ID NO: 11514

SEQ ID NO: 11517 - RNA, 62 nt, Human
uuggcagauuaucagcuguggacuccagcauguuucugauaauuaugcaagcaacaauucug

SEQ ID NO: 11518 - RNA, 60 nt, Human
cgcuguguaaaacuacugccuugccacucacuguuguauacauuucuuauuuacgauuuu

SEQ ID NO: 11519 - RNA, 62 nt, Human
ugcauuuaagucagagauacgugaauggauguaaugccguuaugcaguauauauuguuaauu

SEQ ID NO: 11520 - RNA, 62 nt, Human
ucugaagaagaggaagggcgaguaggggcaccuggacgcugaugguggccaggaugcucagc

SEQ ID NO: 11521 - RNA, 62 nt, Human
ucaccucuuagaacugguuuuaaccuuuagcugcagcggcuacgcugccacguguguauaua

SEQ ID NO: 11522 - RNA, 61 nt, Human
cauuuucuaguuggaagaaugugauauuuguuguguugguaguuuaccuaaugcccuuacc

SEQ ID NO: 11523 - RNA, 62 nt, Human
ucaguccacuguaccuugaaguauggucuaaaugauucggcacuucuggauguugaggaagg

SEQ ID NO: 11524 - RNA, 59 nt, Human
ucuggucagcccuggagcaugggaucgugggaaagaggagggggaccaggcccagggca

SEQ ID NO: 11525 - RNA, 62 nt, Human
cugaacugaggcuccagcaucuagugguggaccggccggucacugcaggggucugguggucu

SEQ ID NO: 11526 - RNA, 62 nt, Human; identical to SEQ ID NO: 10921

SEQ ID NO: 11527 - RNA, 62 nt, Human
auaugcauacauaugauuuuuuuuuuucauuuaaguguuggaagaugcuaccuaacagccac

SEQ ID NO: 11528 - RNA, 62 nt, Human
ccaccaagugccucccucuuuaauuagaggucaucauggaaauggucgggauauuuacgugg

SEQ ID NO: 11529 - RNA, 62 nt, Human; identical to SEQ ID NO: 10365

SEQ ID NO: 11530 - RNA, 62 nt, Human
uaaaaagaaaaaacaaacaacaacaaaaaaaacucuucggaauaaagagggcuguaaauuuu

SEQ ID NO: 11531 - RNA, 62 nt, Human; identical to SEQ ID NO: 9434

SEQ ID NO: 11532 - RNA, 60 nt, Human
gcuucgccggacaaugucgaaguccagucugugccggggaaggcacugguuaggaaggau

SEQ ID NO: 11533 - RNA, 62 nt, Human
uugagggcucaagccauaaacaaauaugcuccccuaaacauauucggcuugaaaaaguuguu

SEQ ID NO: 11534 - RNA, 62 nt, Human
gcaacuggacgugcagaucgccucggagcacgccuccuuagagggcaugagggucgucuucc

SEQ ID NO: 11535 - RNA, 62 nt, Human
ggcucagauaagugagcucugggccaugagaggguagguccagaagguggggggaacuguac

SEQ ID NO: 11536 - RNA, 62 nt, Human
gucugcaaaacacuugccugaauacauaucacguauuuuagacucgaagccucaaagcacug

SEQ ID NO: 11537 - RNA, 62 nt, Human; identical to SEQ ID NO: 9391

SEQ ID NO: 11538 - RNA, 60 nt, Human
aagcagugguaauucaaaaugagaggguccccugccucuagagucaucaucuaauugggg

SEQ ID NO: 11539 - RNA, 62 nt, Human; identical to SEQ ID NO: 10791

SEQ ID NO: 11540 - RNA, 60 nt, Human; identical to SEQ ID NO: 10563

SEQ ID NO: 11541 - RNA, 62 nt, Human
agugagcuguggguggccuggguguguccuguggacggcggagacuguugauuuggauguug

SEQ ID NO: 11542 - RNA, 60 nt, Human
acuaccugcucaggcccuccccucccaugcaggccgaugacaacugcagcccucucugca

SEQ ID NO: 11543 - RNA, 62 nt, Human; identical to SEQ ID NO: 11496

SEQ ID NO: 11544 - RNA, 60 nt, Human
agcauuuuaggauuugacuuuuucacuaaccaguugacgagcagugcauuuacaaggcac

SEQ ID NO: 11545 - RNA, 62 nt, Human; identical to SEQ ID NO: 9738

SEQ ID NO: 11546 - RNA, 61 nt, Human
cgagccugaauccuugccugugucugacgggaccacuacuaaaaaccuaaaaauaucugug

SEQ ID NO: 11547 - RNA, 62 nt, Human
augcaaaagucauauuuuagcaauuucuucagacgauauacagaaccccagcgcucagccgu

SEQ ID NO: 11548 - RNA, 62 nt, Human; identical to SEQ ID NO: 10486

SEQ ID NO: 11549 - RNA, 62 nt, Human; identical to SEQ ID NO: 11547

SEQ ID NO: 11550 - RNA, 62 nt, Human; identical to SEQ ID NO: 10486

SEQ ID NO: 11551 - RNA, 62 nt, Human
uggcaccacuuauugcacuccagcccgggcgacagagcgagacuccaucuaccagauccuua

SEQ ID NO: 11552 - RNA, 62 nt, Human
ugacgggcacagccagaagcugcaccuggccgagaacgccgagccugaggagcaguccgcug

SEQ ID NO: 11553 - RNA, 62 nt, Human
ccccgguucaacccuaccagcuugugguaacuuacugucacauagcucugacguuuuguugu

SEQ ID NO: 11554 - RNA, 62 nt, Human
cuuggaaccuaaauugaacugccaaguacugcgcaugcaagagacccuuuauuggccuuaca

SEQ ID NO: 11555 - RNA, 62 nt, Human
gcaucccguaaaguuguaguugcagaaucccaaacuaggcuacauuucaaaauucagggcug

SEQ ID NO: 11556 - RNA, 61 nt, Human
gguugccggggguagggguggggccacacaaaucuccaggagccaccacucaacacaaugg

SEQ ID NO: 11557 - RNA, 62 nt, Human
uauugucuauuauaaagcucauuauaauauaaaagugaaguacaaaaguuguaaguuuccua

SEQ ID NO: 11558 - RNA, 62 nt, Human
gauugguagacagaagggugcagaggcgcccaggggaguacauugccccgugcaaagcaggg

SEQ ID NO: 11559 - RNA, 62 nt, Human
cuagagagccugguguugggucaugcugggaagggagcggcagcccagccaggccuggccca

SEQ ID NO: 11560 - RNA, 60 nt, Human
agucauuuuguaauauuugaauuuuuacauuuguuguacaaucaggaaaagcaauaaaga

SEQ ID NO: 11561 - RNA, 62 nt, Human
ucuccaaggauuggucuugagaacacuguucagugacggccaugcagguggccguccaaaga

SEQ ID NO: 11562 - RNA, 59 nt, Human
acugcuaccuguuuacccacccuggucccucccagacaagcaaggccucugauuucuuu

SEQ ID NO: 11563 - RNA, 62 nt, Human; identical to SEQ ID NO: 10978

SEQ ID NO: 11564 - RNA, 60 nt, Human
cgugugugaaccugucaacucucugucgucuuuggagcgauacaguuguguuguuaaucu

SEQ ID NO: 11565 - RNA, 62 nt, Human
gugccaaguuccucacucauucgcgcuccuguaggccgucuagaacuggcaugguucaaaga

SEQ ID NO: 11566 - RNA, 61 nt, Human
ggccgcagggacgacacucuccagggaggccccagcaaccacaccaucuucuugcugugag

SEQ ID NO: 11567 - RNA, 62 nt, Human; identical to SEQ ID NO: 10260

SEQ ID NO: 11568 - RNA, 61 nt, Human; identical to SEQ ID NO: 11566

SEQ ID NO: 11569 - RNA, 62 nt, Human; identical to SEQ ID NO: 9941

SEQ ID NO: 11570 - RNA, 62 nt, Human
cugacuucagcaacagcugugggugggcuggaggccggcgcagcuuggggccccccgcgcca

SEQ ID NO: 11571 - RNA, 62 nt, Human
cucuuuaauuagaggucaucauggaaauggucgggauauuuacguggugccuggcuugagua

SEQ ID NO: 11572 - RNA, 62 nt, Human
agaugcagacuggucuuuuagagacggcaugguauauuacuauuuccacauaaugaggagcc

SEQ ID NO: 11573 - RNA, 62 nt, Human
cucuucuccagaggaaaaguacuaggauucuuaagauggcgagaccccaagagggaucucau

SEQ ID NO: 11574 - RNA, 62 nt, Human; identical to SEQ ID NO: 10528

SEQ ID NO: 11575 - RNA, 62 nt, Human; identical to SEQ ID NO: 9901

SEQ ID NO: 11576 - RNA, 62 nt, Human; identical to SEQ ID NO: 9391

SEQ ID NO: 11577 - RNA, 62 nt, Human; identical to SEQ ID NO: 11541

SEQ ID NO: 11578 - RNA, 61 nt, Human
ccaaaaccuugauuacagccauggggugggggugggggucaggggcgucugacuauggcug

SEQ ID NO: 11579 - RNA, 62 nt, Human
gccaugcuguugcuugcgucucgaaucuucgguucucgaggaaguguugacagugugaugcu

SEQ ID NO: 11580 - RNA, 62 nt, Human
cuggucucggucugcugacgucagggucagcucccccgcggagcugacuucagcagcccaca

SEQ ID NO: 11581 - RNA, 62 nt, Human
cugccucauugcacuccccaaaagagguaacauaaacggauagaaacccggcauuucagugu

SEQ ID NO: 11582 - RNA, 62 nt, Human
gccacggggaggcuccugcaggaggcucaacccgacggaucacagugaaagggauuccuccc

SEQ ID NO: 11583 - RNA, 62 nt, Human; identical to SEQ ID NO: 11502

SEQ ID NO: 11584 - RNA, 61 nt, Human
aaucagcacgccuaaauagcaucccaaaccacugugcgacauuuggccugcagaauaagaa

SEQ ID NO: 11585 - RNA, 62 nt, Human
aaucaacaaccuguaucuggacuagcuugcuacccacgaugaaaagcacuuugaaauuuauu

SEQ ID NO: 11586 - RNA, 62 nt, Human
aauugauugguagguuuucauaagcauuguuucuuuaaggcauggaaagggaagaaugcuca

SEQ ID NO: 11587 - RNA, 62 nt, Human
uuuucaaagacuugggggagugaaggcagagccuggugcagauggacgaggucugcagacgg

SEQ ID NO: 11588 - RNA, 58 nt, Human
cgggugucuguggagggggcuccgguccagguacugcacuggacacugcucaucccug

SEQ ID NO: 11589 - RNA, 62 nt, Human
agccaaaguuaggccacaccaggcccaacccugugcuggucaagccagggcagucacagcug

SEQ ID NO: 11590 - RNA, 60 nt, Human
guuuucccuuccucucugacccagaucugcgcgcggccuagcccgggccucauuucuuau

SEQ ID NO: 11591 - RNA, 62 nt, Human
caggacauguguaguuuuguuuguucaguaucccacaacuuaaggcugggagauggaacucu

SEQ ID NO: 11592 - RNA, 62 nt, Human
gccacugcgcccagccugaaucauuucuuauaccuucugacagcccaacuuccagaggacag

SEQ ID NO: 11593 - RNA, 62 nt, Human
auuuugcacagugccuuuacagauuuacguaugggcugaugaagaggccuucuuaaguucca

SEQ ID NO: 11594 - RNA, 62 nt, Human
uggaaacugcugucuaggaccaccugcccuaaccaggaauaaaggcaagacagccuggagac

SEQ ID NO: 11595 - RNA, 62 nt, Human
uacacaggugauaaacaguuucgagaaaauaaaaauuggcuagaaucucaaguuauguguuu

SEQ ID NO: 11596 - RNA, 61 nt, Human
uggaagaaaaaaugaugauagagucccaaaaagaagagaaaaaaaaugcccaaguugcccu

SEQ ID NO: 11597 - RNA, 62 nt, Human
uucccugggaaaauacaaugaauaaauaaagacuuauugguacgcaaacugucauccccuug

SEQ ID NO: 11598 - RNA, 61 nt, Human
gcugcuuauugucuaauuuacagggauauuuaauuuugucaggucuauguauauuuaucca

SEQ ID NO: 11599 - RNA, 62 nt, Human
ccugccuaccccaagaugccccuccccacccugaccgugcuaacuguguguacauauauauu

SEQ ID NO: 11600 - RNA, 61 nt, Human
ucagccuggauggaaccccgguacaaggaggcagcuaaccacugugcccugcugcaggagc

SEQ ID NO: 11601 - RNA, 62 nt, Human; identical to SEQ ID NO: 9309

SEQ ID NO: 11602 - RNA, 59 nt, Human
gguccaguucugaccugagcacgguuuuuccucaugugacuucugggaaggcgcucccu

SEQ ID NO: 11603 - RNA, 62 nt, Human; identical to SEQ ID NO: 10885

SEQ ID NO: 11604 - RNA, 61 nt, Human
aagaugcuggugaagagcuuuugcucuugcauuagauuugaagauguuuacauuguuguua

SEQ ID NO: 11605 - RNA, 62 nt, Human
cugaccauucuuguuauuguuaaaaugcagaggaaucuggaaauauuuauauccacggaguc

SEQ ID NO: 11606 - RNA, 61 nt, Human
uguaugcaugagacucaacaucaggauccacagcuuaaagaugggaauucagguaugaaag

SEQ ID NO: 11607 - RNA, 62 nt, Human
auauagggcuguauucaaacaucguguggaacuguacaaauauuuauaccaaaaauauagau

SEQ ID NO: 11608 - RNA, 62 nt, Human
ggggcaggccuccuuccugccccucgagacacucuugggagaugcauuuuccgucuggcuca

SEQ ID NO: 11609 - RNA, 62 nt, Human; identical to SEQ ID NO: 10853

SEQ ID NO: 11610 - RNA, 62 nt, Human; identical to SEQ ID NO: 10854

SEQ ID NO: 11611 - RNA, 62 nt, Human; identical to SEQ ID NO: 10452

SEQ ID NO: 11612 - RNA, 60 nt, Human
cacacaaaagcccaugguugcgguugcaucuacaccguuaguuggcaaaggauccugcuu

SEQ ID NO: 11613 - RNA, 62 nt, Human
cuucaaucccgagauuucacaucuggaaagccuaagaauuuacaaagauguucugcuaaaac

SEQ ID NO: 11614 - RNA, 62 nt, Human
acaaugagaccauggcucaaaaaaaaaaaaaaaaaaaagauaagcaguggaggccgaaucau

SEQ ID NO: 11615 - RNA, 62 nt, Human
cuugaugugagagagacucugagacuucuuccaucgcaaugaccuguauuaaacacaagccc

SEQ ID NO: 11616 - RNA, 62 nt, Human
uucuggaaauaugucuuuaaguauuuuagacauuccucgucaguauuaggaauuuccauggg

SEQ ID NO: 11617 - RNA, 62 nt, Human
guuugacucaagccuucgggccucaguucauugaccagaugacagccacgugaugauuaggg

SEQ ID NO: 11618 - RNA, 62 nt, Human
uaucuauugagaaauuauuuugcagugguuuuagugggugaaaaugucccaucugcaccagu

SEQ ID NO: 11619 - RNA, 62 nt, Human
cagcccccucccccgcaccccggaaccggcgucgcuggcgcauccuggguggaggcaggccc

SEQ ID NO: 11620 - RNA, 61 nt, Human
aggaugcuucaugcccuguucaaaacuagaagugcgcaugaggaagagaccauaaaggcuu

SEQ ID NO: 11621 - RNA, 62 nt, Human
uguggaagugucacacggcaccuguacaaaaagacuggcuaaccccucuuccuauuaccuug

SEQ ID NO: 11622 - RNA, 57 nt, Human
uaaaaccaguaaggagacuugaaauucagaaaaucaacacauuuuuaaaugacuaac

SEQ ID NO: 11623 - RNA, 62 nt, Human; identical to SEQ ID NO: 10207

SEQ ID NO: 11624 - RNA, 62 nt, Human
aacagugaaggcguuugugaggucuuucuggucccagcaugaaauaaagccuuggccugggg

SEQ ID NO: 11625 - RNA, 62 nt, Human
gauucuaguggcaguauucuuguaaccuguuagacguggauauaccucuucaggauggccuc

SEQ ID NO: 11626 - RNA, 61 nt, Human
ggcagaggcccaucuggccugaacugaggcuccagcaucuagugguggaccggccggucac

SEQ ID NO: 11627 - RNA, 62 nt, Human; identical to SEQ ID NO: 11625

SEQ ID NO: 11628 - RNA, 61 nt, Human; identical to SEQ ID NO: 11626

SEQ ID NO: 11629 - RNA, 62 nt, Human
aaauagaaaaaggcguagagauagaagagaagauaguggauaaucuucagucucgacacaca

SEQ ID NO: 11630 - RNA, 56 nt, Human
acugcugucuaggaccaccugcccuaaccaggaauaaaggcaagacagccuggaga

SEQ ID NO: 11631 - RNA, 62 nt, Human
ggcagggccaacagcagcccccgggccagguguccuggagcagcagcagcugcccgugcagg

SEQ ID NO: 11632 - RNA, 54 nt, Human
gaaggggccaggggccugcaggccucccccuggaacugggacuggucucggucu

SEQ ID NO: 11633 - RNA, 62 nt, Human
ucacccaccaaaguuagcugaaagcagggcacuccuggauaaagcagcuucacucaacucug

SEQ ID NO: 11634 - RNA, 56 nt, Human
auuuugggacugaggcugcagcauuggaacaaaagagcauuauuucaauuuuucuu

SEQ ID NO: 11635 - RNA, 62 nt, Human
gaacucauuugguuuuucuccucucuuauuuuuuuggguagagacagggucccuuuguugcc

SEQ ID NO: 11636 - RNA, 60 nt, Human
gcccaggggcaucugugggagagaggaggguggugccauaccugcugcaucaggcaucaa

SEQ ID NO: 11637 - RNA, 62 nt, Human; identical to SEQ ID NO: 10892

SEQ ID NO: 11638 - RNA, 58 nt, Human
ugucaguggcagaguuuggcugugaccuuugccccuaacacgaggaacucguuugaag

SEQ ID NO: 11639 - RNA, 62 nt, Human; identical to SEQ ID NO: 9901

SEQ ID NO: 11640 - RNA, 62 nt, Human; identical to SEQ ID NO: 9391

SEQ ID NO: 11641 - RNA, 62 nt, Human; identical to SEQ ID NO: 10819

SEQ ID NO: 11642 - RNA, 62 nt, Human
ggggagcaaucccagcggaucgcuccgggccaccaagccgcaccugugccugagacuccgga

SEQ ID NO: 11643 - RNA, 62 nt, Human; identical to SEQ ID NO: 10819

SEQ ID NO: 11644 - RNA, 62 nt, Human; identical to SEQ ID NO: 11642

SEQ ID NO: 11645 - RNA, 62 nt, Human; identical to SEQ ID NO: 10819

SEQ ID NO: 11646 - RNA, 62 nt, Human
gaggagggaggagggaaccuggcgggggugucugaggccgcacugucagcuggccgguccaa

SEQ ID NO: 11647 - RNA, 62 nt, Human
uccuccacuuggcaggcagggccaacagcagcccccgggccagguguccuggagcagcagca

SEQ ID NO: 11648 - RNA, 62 nt, Human
cuccuagucucuguucgcucgcuuaagcuguuuugaagccaagugaagagugugguuugcau

SEQ ID NO: 11649 - RNA, 62 nt, Human; identical to SEQ ID NO: 9624

SEQ ID NO: 11650 - RNA, 62 nt, Human
ggaaaggccauaaaauaucugguucauaucaccuguuggacauuuccuuuuggauucaugcu

SEQ ID NO: 11651 - RNA, 62 nt, Human
uucuuaacuggggugucuuauaacaaaaaacucuuaggucuaaaaugagaaaaaagagagaa

SEQ ID NO: 11652 - RNA, 62 nt, Human
aacacgcugcucccccuggggcagcuguugggauucugauuaaaagaggggaaacgaucauc

SEQ ID NO: 11653 - RNA, 62 nt, Human
gcagggcuguucccuccaggcaaaugcccuucaaaccgacgaucauugugcccacuuacccu

SEQ ID NO: 11654 - RNA, 60 nt, Human
uuuaggaucuguacauagagaaauauuuaaauuuuuagaagcaaaacuuauacaacauua

SEQ ID NO: 11655 - RNA, 62 nt, Human
cccucugaugggacgguacugagauaucucggcuuccgcucagcccgguuuugacugguuga

SEQ ID NO: 11656 - RNA, 58 nt, Human
cccaaagauagaaauaaaaagaggagcagugucggggagcuuggggccugguguucca

SEQ ID NO: 11657 - RNA, 62 nt, Human; identical to SEQ ID NO: 10667

SEQ ID NO: 11658 - RNA, 62 nt, Human
agcuucucucccuuuccagcaagggcagagcuccuaaagccagggguuagcaccuggccagc

SEQ ID NO: 11659 - RNA, 62 nt, Human
uuaauaggguaaauucucuauuuuuuguaauguguucggugauuucagaaagcuagaaagug

SEQ ID NO: 11660 - RNA, 62 nt, Human
uucaaggcgguggauuuagaggaauccuggcuuucauuuucaaugccagucugagacauguu

SEQ ID NO: 11661 - RNA, 62 nt, Human
uaguauuuucuaagguugaucaucuuauaccacgaaucguuaauuuugacaguucuacugau

SEQ ID NO: 11662 - RNA, 62 nt, Human
auaaugaggagccaaagaaaucugauguuuuuaacaauuaaacugcuaauguuaaauugaga

SEQ ID NO: 11663 - RNA, 62 nt, Human
uagcugugcguuuugcuaucauugcuaagagauucccgcugauugggcucagugccagcugu

SEQ ID NO: 11664 - RNA, 58 nt, Human
gggccaacagcagcccccgggccagguguccuggagcagcagcagcugcccgugcagg

SEQ ID NO: 11665 - RNA, 62 nt, Human; identical to SEQ ID NO: 10060

SEQ ID NO: 11666 - RNA, 60 nt, Human
gccccgagagacaggccucacguaacuuuacugcagccgagguccaggccguggaggggg

SEQ ID NO: 11667 - RNA, 62 nt, Human
gaacaaaagucauucuaacaauugccuucagcgucacgugcauugccacugcgcuuucggca

SEQ ID NO: 11668 - RNA, 60 nt, Human
gugggucugcacagcccagcccagcccaaggcccccaggagcugggacucugcuacaccc

SEQ ID NO: 11669 - RNA, 62 nt, Human
ucugguguggaaacacugcccagggagaaaggaggaagcucacuguggacagucuucuuucc

SEQ ID NO: 11670 - RNA, 60 nt, Human
ucuucaaggaucaaaagagacuugccuuuuaaggaucgaaaguacgccaaugugaauuuc

SEQ ID NO: 11671 - RNA, 62 nt, Human
aagcucgagggggccacaccgugucccagggagcccagccuauucccguuggcuggcugggc

SEQ ID NO: 11672 - RNA, 59 nt, Human
cagugaagucaauugaguaaggacaccuccagccauacagaaaccaacacugugugggg

SEQ ID NO: 11673 - RNA, 62 nt, Human; identical to SEQ ID NO: 11671

SEQ ID NO: 11674 - RNA, 55 nt, Human
gucgucagcuggcacugucucugcugcagcggccacacuguacucugcacuggug

SEQ ID NO: 11675 - RNA, 62 nt, Human
ugcauauagacgcaucuauuggaaaugcaguuccacaggugagcauguucuuucuggugacc

SEQ ID NO: 11676 - RNA, 60 nt, Human
gcugacccccuaacuuugggucccggcccuaggugcgcgauccgccagaauuugucuguc

SEQ ID NO: 11677 - RNA, 62 nt, Human
uggcagaagggccccuccuuugggagaccuugucagucagcaucucuagggcaaccgugauu

SEQ ID NO: 11678 - RNA, 62 nt, Human
cacucacuucugacuuuagccucgugcugagccguguauccaugcagucauguucacgugcu

SEQ ID NO: 11679 - RNA, 62 nt, Human
cucuaguaugaagcaagaguaaagacuaagguuucgagagcauuccuacucacauaagugaa

SEQ ID NO: 11680 - RNA, 55 nt, Human
guggagggccccaggacagggacccaaaagcuugacgucacugaacagggcuggg

SEQ ID NO: 11681 - RNA, 62 nt, Human
guggcucacgccuggaaucucagcgaggccaaggagaguggaucaccugaggucgggaguuc

SEQ ID NO: 11682 - RNA, 60 nt, Human
acuucaacaugcacuucugcaggggccgcaguucagccaacaucaucuuuuuuuuugaga

SEQ ID NO: 11683 - RNA, 62 nt, Human
cagggaaaaggugguagugagcauagaacugcaacaguuauauucugagucaaaguuggggc

SEQ ID NO: 11684 - RNA, 62 nt, Human
ugcaaauaacuaaccaaaagaagucccugggacuguuucagacuuggaaaggucacagaagg

SEQ ID NO: 11685 - RNA, 62 nt, Human
auaagcuuuuaaacuggugucuuuggaaggaagguagauacaaaaagauugugguaaaaacu

SEQ ID NO: 11686 - RNA, 62 nt, Human
guuuucuacuuaaacauaaugucugugucaucaaguauuauagucagacuuuucuuuuuuuc

SEQ ID NO: 11687 - RNA, 62 nt, Human
ugugcuccuagcugcacgguggcugcuggccacaccacggcaaguggcagcaggggccggcc

SEQ ID NO: 11688 - RNA, 61 nt, Human
uuuuccucccuacccgccaauguuagagggggacggucguagggggacguugguuauauuc

SEQ ID NO: 11689 - RNA, 62 nt, Human
ugaauaaugcacuuuaaaacaaggaaccguaucaggccagcaugguggcucaugccuguaau

SEQ ID NO: 11690 - RNA, 62 nt, Human
accuccugaggcugugggccacagccaccucugcaucuucgaacucagccauguggucaaca

SEQ ID NO: 11691 - RNA, 62 nt, Human
gguggcaaggccuggccgggccuuccuuccuggccuuagccaccuggcucugucugcagcag

SEQ ID NO: 11692 - RNA, 62 nt, Human
gaacaccagcugauugagagaaggggaaugagaagagcuggaugaguuuaaauaacucauug

SEQ ID NO: 11693 - RNA, 62 nt, Human; identical to SEQ ID NO: 9513

SEQ ID NO: 11694 - RNA, 61 nt, Human
caccagccacgaaggacggaggcgggcggggccccggagaacccugucccugcguguggcc

SEQ ID NO: 11695 - RNA, 62 nt, Human; identical to SEQ ID NO: 9390

SEQ ID NO: 11696 - RNA, 62 nt, Human; identical to SEQ ID NO: 10514

SEQ ID NO: 11697 - RNA, 62 nt, Human; identical to SEQ ID NO: 10165

SEQ ID NO: 11698 - RNA, 62 nt, Human
gcccccucugucccgucccccugcccaagugacugaaaccuacugagcuauauucacugugc

SEQ ID NO: 11699 - RNA, 62 nt, Human
aaacaaaacaaaaaagacaaaaccuaaaacugagcuaucuaagggggaggguccccgcaccu

SEQ ID NO: 11700 - RNA, 62 nt, Human
caaauguuccacaaggcgggaguguuucacuuucuggugauaaacuugauggucauuguuau

SEQ ID NO: 11701 - RNA, 62 nt, Human
gugacgagggugagguggccacagugaccggacgacaaaugagacucugcaaaugagacucc

SEQ ID NO: 11702 - RNA, 62 nt, Human; identical to SEQ ID NO: 11608

SEQ ID NO: 11703 - RNA, 62 nt, Human
uugggagaugcauuuuccgucuggcucacagggggagggugaggcuuuguaccccagccccu

SEQ ID NO: 11704 - RNA, 62 nt, Human; identical to SEQ ID NO: 10896

SEQ ID NO: 11705 - RNA, 62 nt, Human; identical to SEQ ID NO: 10250

SEQ ID NO: 11706 - RNA, 62 nt, Human; identical to SEQ ID NO: 11302

SEQ ID NO: 11707 - RNA, 62 nt, Human
cauguucagcacuuuaauuuuuuugccuuacuuucaugugcaaugagaauuacuuaagaauu

SEQ ID NO: 11708 - RNA, 62 nt, Human
ggcuaggacugugggcuuuuagcagcccacaggugauccuaacauaucaggccauggacuca

SEQ ID NO: 11709 - RNA, 62 nt, Human
augucuuuuaaauguuugaguuuaaagugguaaugcccgauaugcuaguacagugucaguua

SEQ ID NO: 11710 - RNA, 60 nt, Human
ggcucaagcaauccaccuggcugggccucccaaagcgauaggauuacaggcguaagggcc

SEQ ID NO: 11711 - RNA, 62 nt, Human
ccacgguguccccgccgggaagcagccccggcuccugaaucacccucgcuccgucaggcggg

SEQ ID NO: 11712 - RNA, 62 nt, Human
caaauguacuuguguagagacauuuccuuaagagaaagccuaggagaagccgauuuggaggu

SEQ ID NO: 11713 - RNA, 62 nt, Human
ccaaaaauggugagcgaucauuuauuucaugauucaaccugauacauuuacauagugcaaaa

SEQ ID NO: 11714 - RNA, 62 nt, Human
cuguucaaacauguuuuugaauauacauucuauaaaagauuauuugaaagacaaaauucaua

SEQ ID NO: 11715 - RNA, 62 nt, Human
caggacucaggccacccucgcuuguccuggcgcccggcggcagcugcccagaaacuuccugg

SEQ ID NO: 11716 - RNA, 62 nt, Human
uuuuguucuuuucugucacugauccguauuaccacuuuuggaaaaaaauaaauaaauaaaua

SEQ ID NO: 11717 - RNA, 62 nt, Human
auggcugccucuccuauuaucuauuaucacugaaacuuaguagccugcuuuuuuuuuuuuuu

SEQ ID NO: 11718 - RNA, 62 nt, Human
uacaaaacucacacucucacaaugcauuguuaaguauguaaaagcaauaacauugauucucu

SEQ ID NO: 11719 - RNA, 62 nt, Human
agaccguucgcauggcagccaucaaagaguccuggacgcacaauauccagcgagagaaagag

SEQ ID NO: 11720 - RNA, 61 nt, Human
accacaccguaacggggccauguaacugugcagcauggacagggaugcgacggggcagcug

SEQ ID NO: 11721 - RNA, 62 nt, Human
ggaaccacagacugugacagagaagguggcgaccagcccagaagaggcccacccucucgguc

SEQ ID NO: 11722 - RNA, 56 nt, Human
uucagauuugggaggaagccuaucagcgaguggcuaaugagcaggagauuuaugaa

SEQ ID NO: 11723 - RNA, 62 nt, Human
cuucuaaaagccccaacacaugacgccaucugaagacccgcaacggaguggggguggcggcc

SEQ ID NO: 11724 - RNA, 60 nt, Human
cagggcacccccuguuguaggcacuggcuagggaggggcaggccuccuuccugccccucg

SEQ ID NO: 11725 - RNA, 62 nt, Human
ggcacccguggaugagcagucagagagucuacagaacacgcacgacgacagcaggaacaacg

SEQ ID NO: 11726 - RNA, 61 nt, Human
acagggcacggaaaaucuuaugcugcuccgucauaaaccuacaccaaugcccagcaaucac

SEQ ID NO: 11727 - RNA, 62 nt, Human
cccaugaaugcucacgcaaguguaaugacagaccugaauaaaauguauuaagcagcagugau

SEQ ID NO: 11728 - RNA, 62 nt, Human
cgugaggucaagaguucaagaccagccuggccaauauggugaaaccccaucucuacuaagaa

SEQ ID NO: 11729 - RNA, 62 nt, Human; identical to SEQ ID NO: 10110

SEQ ID NO: 11730 - RNA, 62 nt, Human
gggacgggugcuucccacaccucugggagaaggcugcagccaccugggggucccaggguggu

SEQ ID NO: 11731 - RNA, 62 nt, Human; identical to SEQ ID NO: 9615

SEQ ID NO: 11732 - RNA, 62 nt, Human
uuuuuuauuuuuauuccagacagagucucgcacugucgccuaggcuggagugcaacagugug

SEQ ID NO: 11733 - RNA, 62 nt, Human
auaggaagcggaaggggaaucgcgggaagcuggcccaggucagguccgcaaaggcuucugaa

SEQ ID NO: 11734 - RNA, 62 nt, Human
ugauauauuaaaauggccaguuaggcucuuuuuguaguugaauugucuucuaaagagauugg

SEQ ID NO: 11735 - RNA, 62 nt, Human
guggcugacgauuucaaccucacacagcaguuuguaaccgcaagcauucucuuugaauucuc

SEQ ID NO: 11736 - RNA, 62 nt, Human
uauugaaaaagaaaucaaauguaaaugucugguuuucauauaauguuuaaaaagaccauuga

SEQ ID NO: 11737 - RNA, 62 nt, Human; identical to SEQ ID NO: 11179

SEQ ID NO: 11738 - RNA, 62 nt, Human
gagcaagaggcccugggucucuccaagcagcugcagaccccagcucgaauuuugcacauggc

SEQ ID NO: 11739 - RNA, 62 nt, Human
gguggagggaagugcacgcgaaacagacacagcggcuucaaauagaugccgccccugcccgc

SEQ ID NO: 11740 - RNA, 61 nt, Human
uuggaaccuaaauugaacugccaaguacugcgcaugcaagagacccuuuauuggccuuaca

SEQ ID NO: 11741 - RNA, 62 nt, Human
cucccugaccugucacgagccucugcaggugccugcucaccauggcccagcgccacucuguc

SEQ ID NO: 11742 - RNA, 61 nt, Human
gaucugcggucuccagacaucauaggccaugugacccacuaggggccgcuuaccccuggcc

SEQ ID NO: 11743 - RNA, 62 nt, Human
ugagucccggugucagucggcacaguccaguguccaucugcauuugcucaugcagagggggu

SEQ ID NO: 11744 - RNA, 60 nt, Human
ucaagcugauccaguaggugcagcugccgcagccgggggaggccugcccgggaaggcugc

SEQ ID NO: 11745 - RNA, 62 nt, Human
cacuucccacuuggacaucacugcuggacauucccaucgagaugacaccuggguuccaaucc

SEQ ID NO: 11746 - RNA, 59 nt, Human
ccaucuucuaaaggcuuuugcccuacucagcccaaccuagaccuguagauuucccucuc

SEQ ID NO: 11747 - RNA, 62 nt, Human; identical to SEQ ID NO: 10288

SEQ ID NO: 11748 - RNA, 62 nt, Human
cuuucucucugacuauacuuaguuugaaauggugcaggcuuagucuuaagccuccaaaggcc

SEQ ID NO: 11749 - RNA, 62 nt, Human
caagugugagucccggugucagucggcacaguccaguguccaucugcauuugcucaugcaga

SEQ ID NO: 11750 - RNA, 61 nt, Human
cgagcugugcccugggcaucacugagcagaggggugcggcagcuucaggaggcagaaacga

SEQ ID NO: 11751 - RNA, 62 nt, Human
aguagagacaggguuucaccauguugcccaggcuggucucgaacuccugagcucaggcaguc

SEQ ID NO: 11752 - RNA, 61 nt, Human
gagaccuugggccuuuggccuguggggcacuggggaugguaaccucacugccccgucacuc

SEQ ID NO: 11753 - RNA, 62 nt, Human
auugaaguuuacauuuccaugugcuguugaucaacggcgccaccuguguuugcugagacugg

SEQ ID NO: 11754 - RNA, 62 nt, Human
uggggccucgccuggcgggaccccgcagcagccccggccccauccccgcccagagccgggcg

SEQ ID NO: 11755 - RNA, 62 nt, Human; identical to SEQ ID NO: 11424

SEQ ID NO: 11756 - RNA, 60 nt, Human
accaccccuccccauccucagccuggauggaaccccgguacaaggaggcagcuaaccacu

SEQ ID NO: 11757 - RNA, 62 nt, Human
aaucucagcucacugcaagcucugccucccagguucgcgccauucaccugccucagccucug

SEQ ID NO: 11758 - RNA, 62 nt, Human
cacuuauuuccugggcuggugcgccccaaaacacggccccgacacuuaguguggccccaggc

SEQ ID NO: 11759 - RNA, 62 nt, Human
ccuuugaccggcagcucuguguauugguggauagaugcagaaacaaggaagaaauggagucu

SEQ ID NO: 11760 - RNA, 56 nt, Human
cuagaccaggcuccgggcugccaauaaagaagugaaaugcguaucuggucuccugu

SEQ ID NO: 11761 - RNA, 62 nt, Human
auguugaagcaccgaaagauaaaugauuuuuaaaaggcuauagaguccaaaggaauauucuu

SEQ ID NO: 11762 - RNA, 58 nt, Human
cucugccccacgugccggcccuccuggugcucuauccacugcagggccagccacucgc

SEQ ID NO: 11763 - RNA, 62 nt, Human
ccucugggauuaguuaugcagauauuaaaucacccgaagacacuaacuuacagaagacacaa

SEQ ID NO: 11764 - RNA, 62 nt, Human
uccauccgcauggaagcccacgugugcacuuaggggcccauaaauggcagaagggccccucc

SEQ ID NO: 11765 - RNA, 62 nt, Human; identical to SEQ ID NO: 11763

SEQ ID NO: 11766 - RNA, 62 nt, Human; identical to SEQ ID NO: 11764

SEQ ID NO: 11767 - RNA, 62 nt, Human
agguagcugcugaaaggaaaagugaauacagaauugacgguauuauuggagauuuuuccucu

SEQ ID NO: 11768 - RNA, 62 nt, Human
guagugaccuugugauuguuacagcucccuuugaucaaagaaauauagcuuucaggcauaaa

SEQ ID NO: 11769 - RNA, 62 nt, Human; identical to SEQ ID NO: 9388

SEQ ID NO: 11770 - RNA, 62 nt, Human; identical to SEQ ID NO: 9389

SEQ ID NO: 11771 - RNA, 62 nt, Human
ggggaggagagaguuuaggggcccaccuuggcucaguacagauguggaaauugagagccaga

SEQ ID NO: 11772 - RNA, 62 nt, Human
uggucaagccagggcagucacagcugcuuggggcccacagcacugcugccuggucuccacag

SEQ ID NO: 11773 - RNA, 62 nt, Human
uuuuuguuuuucguuuuuuuggucacuccaguagcuccuggaaaaaaccuuaaaaaauguuu

SEQ ID NO: 11774 - RNA, 60 nt, Human
ucuaaacuucccccaugucagucagaugaaguuacuacuauauuucaccacccugcaggu

SEQ ID NO: 11775 - RNA, 62 nt, Human; identical to SEQ ID NO: 9508

SEQ ID NO: 11776 - RNA, 60 nt, Human
caccucgggguggcagagggacggcccccacggcccagcagacaugcgagcuuccagagu

SEQ ID NO: 11777 - RNA, 62 nt, Human; identical to SEQ ID NO: 9508

SEQ ID NO: 11778 - RNA, 60 nt, Human; identical to SEQ ID NO: 11776

SEQ ID NO: 11779 - RNA, 62 nt, Human
acccuagcugaucaauguacuuugcaaucucccccacccuuaagaagguucuuugucauucu

SEQ ID NO: 11780 - RNA, 58 nt, Human
uuucugucacugauccguauuaccacuuuuggaaaaaaauaaauaaauaaauaaauaa

SEQ ID NO: 11781 - RNA, 62 nt, Human
aaccuuuuuaaaaaauggagaugaauguuacagaauuggacaacccgaacugcuuuucaaaa

SEQ ID NO: 11782 - RNA, 62 nt, Human
agaguucaccagugagcucaggugucucaaagaaggguggaaguucuaaugucuguuagcua

SEQ ID NO: 11783 - RNA, 62 nt, Human; identical to SEQ ID NO: 11262

SEQ ID NO: 11784 - RNA, 58 nt, Human
agacuaauuggaauuguugaagcugcucccugguuccacucuggagaguaaucuggga

SEQ ID NO: 11785 - RNA, 62 nt, Human; identical to SEQ ID NO: 9298

SEQ ID NO: 11786 - RNA, 62 nt, Human; identical to SEQ ID NO: 9299

SEQ ID NO: 11787 - RNA, 62 nt, Human; identical to SEQ ID NO: 9298

SEQ ID NO: 11788 - RNA, 62 nt, Human; identical to SEQ ID NO: 9299

SEQ ID NO: 11789 - RNA, 62 nt, Human; identical to SEQ ID NO: 9298

SEQ ID NO: 11790 - RNA, 62 nt, Human; identical to SEQ ID NO: 9299

SEQ ID NO: 11791 - RNA, 62 nt, Human; identical to SEQ ID NO: 9298

SEQ ID NO: 11792 - RNA, 62 nt, Human; identical to SEQ ID NO: 9299

SEQ ID NO: 11793 - RNA, 62 nt, Human; identical to SEQ ID NO: 9298

SEQ ID NO: 11794 - RNA, 62 nt, Human; identical to SEQ ID NO: 9299

SEQ ID NO: 11795 - RNA, 62 nt, Human; identical to SEQ ID NO: 9298

SEQ ID NO: 11796 - RNA, 62 nt, Human; identical to SEQ ID NO: 9299

SEQ ID NO: 11797 - RNA, 62 nt, Human
cccgcgggugucuguggagggggcuccgguccagguacugcacuggacacugcucaucccug

SEQ ID NO: 11798 - RNA, 62 nt, Human
augaauuuuuaauuaagaaaggguaguuugguagucuacuuaaaaauguuucugggaaauuc

SEQ ID NO: 11799 - RNA, 62 nt, Human
ggggggagucucuggggcccugaguucagagcccgucccucagcuccuguuccuuggugcca

SEQ ID NO: 11800 - RNA, 57 nt, Human
ucugcuuugaaaaaaaaaaauuccacaagcuuuuaaaggugcauuuaagaauccaug

SEQ ID NO: 11801 - RNA, 62 nt, Human; identical to SEQ ID NO: 11491

SEQ ID NO: 11802 - RNA, 62 nt, Human; identical to SEQ ID NO: 11492

SEQ ID NO: 11803 - RNA, 62 nt, Human; identical to SEQ ID NO: 10065

SEQ ID NO: 11804 - RNA, 60 nt, Human; identical to SEQ ID NO: 9971

SEQ ID NO: 11805 - RNA, 62 nt, Human
accgugaacugaaaaaaguguuggccuuuuugcgggaccagauuuuuaagauaaaauaaaua

SEQ ID NO: 11806 - RNA, 62 nt, Human
aauaauacgaaccccucucuggcugcacggucgcuuauggcaguuccacacaguaguuggcg

SEQ ID NO: 11807 - RNA, 62 nt, Human
aggaagaugaguugaaaagcaaggggagaagggacgggacuaacauuauugccuaccuucua

SEQ ID NO: 11808 - RNA, 62 nt, Human
guacccugugggugggugggugugacagcaggagcauugccaucuuggacaaacauggccau

SEQ ID NO: 11809 - RNA, 62 nt, Human; identical to SEQ ID NO: 10604

SEQ ID NO: 11810 - RNA, 60 nt, Human
cacccuucaacgcucccagacggucaggaaaacuguuccaaucaugaaaaggggggauga

SEQ ID NO: 11811 - RNA, 62 nt, Human; identical to SEQ ID NO: 10604

SEQ ID NO: 11812 - RNA, 60 nt, Human; identical to SEQ ID NO: 11810

SEQ ID NO: 11813 - RNA, 62 nt, Human
aaaauucaguauguucuagcuacuucacacauguguacgcgacaguuauuuuuacaguaagg

SEQ ID NO: 11814 - RNA, 60 nt, Human
aaauauuuuauucacaaaggucaauaacauggcaagauaaaauuauuuguauaguuuugu

SEQ ID NO: 11815 - RNA, 62 nt, Human
uucuggaucccaggauuaaaacuaaccgugaccacuacuccaaacaaaacacaauaugccua

SEQ ID NO: 11816 - RNA, 62 nt, Human; identical to SEQ ID NO: 9823

SEQ ID NO: 11817 - RNA, 62 nt, Human; identical to SEQ ID NO: 9724

SEQ ID NO: 11818 - RNA, 62 nt, Human
ccacugagggccucgccuggcugcagccugcgccaccgcccagagacccaagcugccucccc

SEQ ID NO: 11819 - RNA, 62 nt, Human; identical to SEQ ID NO: 9724

SEQ ID NO: 11820 - RNA, 62 nt, Human
cuguucccuuggguggagaggugugggcaugagagccacccauugccaagcagcaagaaugu

SEQ ID NO: 11821 - RNA, 62 nt, Human; identical to SEQ ID NO: 9724

SEQ ID NO: 11822 - RNA, 62 nt, Human; identical to SEQ ID NO: 11818

SEQ ID NO: 11823 - RNA, 62 nt, Human
agagcccauucuuaagaucacuuggugccuuaaagacacgcauuccaaaguggaaugugguu

SEQ ID NO: 11824 - RNA, 61 nt, Human
ggcugccgagugaacccucugucccugagcuaacccacauacuagcagaggaggaagucag

SEQ ID NO: 11825 - RNA, 62 nt, Human; identical to SEQ ID NO: 11823

SEQ ID NO: 11826 - RNA, 61 nt, Human; identical to SEQ ID NO: 11824

SEQ ID NO: 11827 - RNA, 62 nt, Human
aucuuguagugggugcacacgcgugcacugggaccccacacagcaauacgaguccaacuuaa

SEQ ID NO: 11828 - RNA, 62 nt, Human
cuggcccaggucagguccgcaaaggcuucugaagaagaggaagggcgaguaggggcaccugg

SEQ ID NO: 11829 - RNA, 62 nt, Human; identical to SEQ ID NO: 11400

SEQ ID NO: 11830 - RNA, 62 nt, Human; identical to SEQ ID NO: 11570

SEQ ID NO: 11831 - RNA, 62 nt, Human
ccgccugccugugcacucacgccaccccccagcccacaaagagcccaucugagagaaggacg

SEQ ID NO: 11832 - RNA, 62 nt, Human; identical to SEQ ID NO: 10854

SEQ ID NO: 11833 - RNA, 62 nt, Human
cugggaacccgcacugugccuggguguauucuuuauacuguagauaauggagaaauuuucua

SEQ ID NO: 11834 - RNA, 62 nt, Human
uccuucacuguuuauuuuuguuuguuuguuuguuuguuuuaaucucuacagcacauuuaaug

SEQ ID NO: 11835 - RNA, 62 nt, Human
acaauccagcaagaaaucccucgcuaguuccacaccuacgcaccgagcgucggugugccagg

SEQ ID NO: 11836 - RNA, 60 nt, Human
cacauacagaaggccucagaaagggaggaggucguaaggacacacagcugaugaaggguc

SEQ ID NO: 11837 - RNA, 62 nt, Human; identical to SEQ ID NO: 11835

SEQ ID NO: 11838 - RNA, 60 nt, Human
ucagagggcaugagggucacaggucagcaaggugugaggagcacaagccagggugccccg

SEQ ID NO: 11839 - RNA, 62 nt, Human
ccccaaggcagaaaccaagaacugucugcaggcaaauaagcacccagcacccauccuggcug

SEQ ID NO: 11840 - RNA, 61 nt, Human
ccucuggugcuugguugaacaagggaaucacaagaaaacgaaaaugcaaaaacugaacuuc

SEQ ID NO: 11841 - RNA, 62 nt, Human
auuugaucagcaagacaucuuggaacucaaucuucuguuggaucacgggaaaucaagacacc

SEQ ID NO: 11842 - RNA, 62 nt, Human
cgagugccugcaguugcaaguauguuuacaccugguguccaauuuuguauuuuaaaauguaa

SEQ ID NO: 11843 - RNA, 62 nt, Human
gguuugcuggauguguuuacauaggacucuaacuugugugcacuacaguuguucaccagggc

SEQ ID NO: 11844 - RNA, 62 nt, Human
gcgcuggcacacaugggugcuggguguggccgagcgccucuaacaagugaaaacacgagugu

SEQ ID NO: 11845 - RNA, 62 nt, Human
ggucugaacccagugugauggggggagucucuggggcccugaguucagagcccgucccucag

SEQ ID NO: 11846 - RNA, 62 nt, Human
cugggaccccagaaacugccguuugggaggcagcaacagcaacgugcccaggcaggcaguua

SEQ ID NO: 11847 - RNA, 62 nt, Human; identical to SEQ ID NO: 11399

SEQ ID NO: 11848 - RNA, 62 nt, Human
cauuagauuugaagauguuuacauuguuguuauuguuauguaucacuugcuaaaaauauugu

SEQ ID NO: 11849 - RNA, 62 nt, Human
ggacaaacauggccauuuuaaguucuccgugauuaaaaaccagcccaaaacaucagccuaau

SEQ ID NO: 11850 - RNA, 62 nt, Human
aauauguugcgguagagauggaauguauaaaauccgccaguagugugauuguuuuucaauuu

SEQ ID NO: 11851 - RNA, 62 nt, Human
caggcgugugucacuguggcugggacggcagcgcucagaggagccuccaguuacuuuccuca

SEQ ID NO: 11852 - RNA, 59 nt, Human
gagccccgcgcccgcuguaauuauuuucuauuuuuguaaacuuguugcuuuuugauaug

SEQ ID NO: 11853 - RNA, 62 nt, Human
gugcuacgugauccucugccgcccagaccucaacagcacagagcacuuccaggccuccauuc

SEQ ID NO: 11854 - RNA, 62 nt, Human
acaccaucuucuaaaggcuuuugcccuacucagcccaaccuagaccuguagauuucccucuc

SEQ ID NO: 11855 - RNA, 62 nt, Human; identical to SEQ ID NO: 9925

SEQ ID NO: 11856 - RNA, 62 nt, Human; identical to SEQ ID NO: 9731

SEQ ID NO: 11857 - RNA, 62 nt, Human; identical to SEQ ID NO: 9925

SEQ ID NO: 11858 - RNA, 62 nt, Human; identical to SEQ ID NO: 9731

SEQ ID NO: 11859 - RNA, 62 nt, Human
ucuaaccuaggaaugaaaaacaccaccaguuugaaucgccuagaugaaaaucuuuuccucug

SEQ ID NO: 11860 - RNA, 62 nt, Human
cccuaaacugacuggacggcugccaaggaggccccaaacccaggccccaugcaaaggcacgu

SEQ ID NO: 11861 - RNA, 62 nt, Human
ccuccguagccccugcacggcaccaguuccccgagggacgcagcaggccgccucccgcagcg

SEQ ID NO: 11862 - RNA, 62 nt, Human
gggaggccgagccugaauccuugccugugucugacgggaccacuacuaaaaaccuaaaaaua

SEQ ID NO: 11863 - RNA, 62 nt, Human; identical to SEQ ID NO: 11861

SEQ ID NO: 11864 - RNA, 62 nt, Human; identical to SEQ ID NO: 11862

SEQ ID NO: 11865 - RNA, 62 nt, Human
gacuggggcaaaagcuccagcguucuggacaagugcugagcaaugugugacccagacguaca

SEQ ID NO: 11866 - RNA, 62 nt, Human
cuggaggcgggccccccuggcagcaguauuggaggggcuacaggcagcuggagaaaggggcc

SEQ ID NO: 11867 - RNA, 62 nt, Human
ccuaaccugcucuugcacacuuuccuucugagccuccauggagaccagccugcaagccggcc

SEQ ID NO: 11868 - RNA, 60 nt, Human
aguuacaacuucacuaucagcggaaggggagaaaaaccgauucaaaucaacuuguacaug

SEQ ID NO: 11869 - RNA, 62 nt, Human
ggguggggccacacaaaucuccaggagccaccacucaacacaauggcccugccucccaccgc

SEQ ID NO: 11870 - RNA, 62 nt, Human
gcacuucauugaaaguagugcuguaaauauucugccauaggaauacugucuacaugcuuucu

SEQ ID NO: 11871 - RNA, 62 nt, Human
aaagucccuaaagcagucguagagucucaccaucuccaaggauuggucuugagaacacuguu

SEQ ID NO: 11872 - RNA, 53 nt, Human
gugccugggaccccgugucugcccaggugggcagccuugagcccaggggacuc

SEQ ID NO: 11873 - RNA, 62 nt, Human
ccacguucucaccuaagcccagagcaaggaacagguauaauaaguggaaaaucuuggaauaa

SEQ ID NO: 11874 - RNA, 53 nt, Human
cgccugagagcggcugagggcugccucacugcaaauccuccccacagcgucag

SEQ ID NO: 11875 - RNA, 62 nt, Human
gggggcugucaugcgguuuccaaggugcacauuuuccacggaaacagaacucgaugcacuga

SEQ ID NO: 11876 - RNA, 58 nt, Human
cuggcagcuucacaaugagcuucuucuggucaggucgacagagacaucuuugacgcaa

SEQ ID NO: 11877 - RNA, 62 nt, Human
uguuaagucuuuuaccaaaagugucuguacagcagccauccaaguugccccuacuuaguggc

SEQ ID NO: 11878 - RNA, 60 nt, Human
ggccacugugagggugggugcuggcugagcccccggggcagcaggagccaggcaggugau

SEQ ID NO: 11879 - RNA, 62 nt, Human
auaauacugugugaauauuuucauuagauuaauucacuaagauuuuauuagagauuguuuga

SEQ ID NO: 11880 - RNA, 62 nt, Human
gugucacgcguggacaucuccucaggcuguccccagcggugacgggagguguccuggcugcu

SEQ ID NO: 11881 - RNA, 62 nt, Human
cuuggagacgaaaguaucugggggauuguuggguacuagggagacuggguacaagggugaaa

SEQ ID NO: 11882 - RNA, 61 nt, Human
aaauuuugaaaauaacaaaaaccagaauacaaacacccauaaucaaucacagagauaacca

SEQ ID NO: 11883 - RNA, 62 nt, Human
aaagcaauaacauugauucucuguuguacuuuuuuguaacuaauucugugagaguugagcuc

SEQ ID NO: 11884 - RNA, 62 nt, Human
guggcggccgccccacccuccccacccggggaagccaucacagcucaucugcccgcggcugc

SEQ ID NO: 11885 - RNA, 62 nt, Human
cuaacuauucucccaucaaaucauauauguugaccugucugaauuauaaaccagccugaccu

SEQ ID NO: 11886 - RNA, 62 nt, Human
uucugccucagccuccugaguagcugggauuacaggugugcaccaccguacccagcuaauuu

SEQ ID NO: 11887 - RNA, 62 nt, Human; identical to SEQ ID NO: 9604

SEQ ID NO: 11888 - RNA, 62 nt, Human
uauaggaggacacugaguaauuuacaaacacaacugcauucauaaaugggaauagaacguga

SEQ ID NO: 11889 - RNA, 62 nt, Human
aaaaaagacgacuaauuuccaaacccguuuguucucagauaaaaagcaguuuuauaaacccg

SEQ ID NO: 11890 - RNA, 60 nt, Human
cagaggaauccacagguccccacccaagaucccucaauuauauggggaagucgagggccu

SEQ ID NO: 11891 - RNA, 62 nt, Human
caggcagccgugcugcagacagaccuagugccgagggauggacaggcgagguggcagcgugg

SEQ ID NO: 11892 - RNA, 62 nt, Human
auuuaaccacagaggggugggcuucacaggagguggcugccacggcggggccgggugcccgu

SEQ ID NO: 11893 - RNA, 62 nt, Human
guuuuuauguucauuugcuggagcgcaagacgugcugacacagugaguuuucucugauguau

SEQ ID NO: 11894 - RNA, 61 nt, Human
ucuuccugugugggagcccauagcuguugucuaacagguaagaaaugaaauugaacuauug

SEQ ID NO: 11895 - RNA, 62 nt, Human
uuuuaauagccuggggaggaucaggguaaaagucaguacggaauagcagggaacuggacauc

SEQ ID NO: 11896 - RNA, 55 nt, Human
ggggucccaguggggcaggccccucugucuggccaccccucuguccuggccccgg

SEQ ID NO: 11897 - RNA, 62 nt, Human; identical to SEQ ID NO: 9877

SEQ ID NO: 11898 - RNA, 62 nt, Human
auaaccgaaggaaagaccguucaccagacuuggcuccucuaaacauuugcuguucaaacaug

SEQ ID NO: 11899 - RNA, 62 nt, Human
aggccaggacugugcagggccagccagcccaugcgcuagucaggagcacaggcaaggggugc

SEQ ID NO: 11900 - RNA, 60 nt, Human
uggagaagccccugggggcucccugauuaauggaggcuuagcuuucuggauggcaucuag

SEQ ID NO: 11901 - RNA, 62 nt, Human
gugcccuuuagacaggcuggccugccgguuccacaggguacaguuaggacuugagucuuucu

SEQ ID NO: 11902 - RNA, 62 nt, Human
ugucuuugucucuuccuuucaccucauucugguagcagcauaaagguuaggcaaucacuggg

SEQ ID NO: 11903 - RNA, 62 nt, Human
cucagccucccgaguagcuggaauuacaagugcgcacuaccacacccagcuaauuuuugcau

SEQ ID NO: 11904 - RNA, 62 nt, Human
agaaaauggagcaaaacuguauaaacugauuuguaacuaacacuggaccauuggaucgauau

SEQ ID NO: 11905 - RNA, 62 nt, Human; identical to SEQ ID NO: 11296

SEQ ID NO: 11906 - RNA, 62 nt, Human; identical to SEQ ID NO: 11059

SEQ ID NO: 11907 - RNA, 62 nt, Human
aguauuuagcuacauaaauguuguaagaucauaucuuauguauagaaguaauaagaccauuu

SEQ ID NO: 11908 - RNA, 62 nt, Human
aauuuuuauaauaaaaugugaacugauguagcaaauuacgcaaaugugaagccucuucugau

SEQ ID NO: 11909 - RNA, 62 nt, Human
gccugggcuguuuuuuuucuuaaacacauuuuauauuacugaacaaccaaaucuacccucca

SEQ ID NO: 11910 - RNA, 62 nt, Human; identical to SEQ ID NO: 10960

SEQ ID NO: 11911 - RNA, 62 nt, Human
uuuguuauguccauuuguuuguauugcguauuuugauuauaaaauaaaguaucuuaacagac

SEQ ID NO: 11912 - RNA, 60 nt, Human
aaaggucgccacccccuagccuguggggugcaucugcgaaccagggugaagucacagguc

SEQ ID NO: 11913 - RNA, 62 nt, Human
ugaaccauccuuucuuuuguauuccccuuccccuauuaccuauuagaccagaucuucugucc

SEQ ID NO: 11914 - RNA, 61 nt, Human
uuauuugcaugccgacuuacauauauuugcauguucguugacuaucaaagagugcagagcu

SEQ ID NO: 11915 - RNA, 62 nt, Human
aaggggaauauuaugugugauuauuuuucuucuuaugcuauauccccaaguuuuucagacuc

SEQ ID NO: 11916 - RNA, 62 nt, Human
gggaagggugagaaguaagcuaacagucuugcuuaguauucaagaaaauccaaacugugucu

SEQ ID NO: 11917 - RNA, 62 nt, Human
cucugaggaaggaaugugauuuggcagucaggguacuaagcaugggugggaacuccugccuu

SEQ ID NO: 11918 - RNA, 61 nt, Human
ucccucgaugugcgucuggguccugaucuccuccucuuauaaggacacaaaucauguuggc

SEQ ID NO: 11919 - RNA, 62 nt, Human
gucaaaugaaauggaaauugguaaauggacaaaagcuagcuaguaaaaaggacgacccagca

SEQ ID NO: 11920 - RNA, 60 nt, Human
aaugaaauuaagugauccaaagcugcugaaguauguuugaacucuccagugcccuauagc

SEQ ID NO: 11921 - RNA, 62 nt, Human
acuguguauguacauauauaucuuucuggccugccuucguuaggcugagccuacagaugaac

SEQ ID NO: 11922 - RNA, 62 nt, Human
uuuaaguaaaucuuacaguggaguauauuuuuuaaagcacaaaauuggugccaagacugggu

SEQ ID NO: 11923 - RNA, 62 nt, Human
guuuauucacaccuuuggagaguugcaacuugccacauacgaaauuagucucauaguguagu

SEQ ID NO: 11924 - RNA, 61 nt, Human
aaggucgagcaggccggggguguccgggaggucuuugggcaucgcggucugggguugggac

SEQ ID NO: 11925 - RNA, 49 nt, Human; identical to SEQ ID NO: 9924

SEQ ID NO: 11926 - RNA, 60 nt, Human
uuucauucuauauguaaauauccugugauaaauacgaauaauuucauuucaauaugagaa

SEQ ID NO: 11927 - RNA, 62 nt, Human
guucaaagcaacacauucacaacccauuucuauucuauagcaaccucgucugugacuccuua

SEQ ID NO: 11928 - RNA, 62 nt, Human
gcugaguuuucacccguaggcaccugaauauagaugagcguaauccucaguuaaccuacacc

SEQ ID NO: 11929 - RNA, 62 nt, Human
cagcucucgauacguuuggucuuucaugcugaaaaauaaauaauaaagccugucccgugucu

SEQ ID NO: 11930 - RNA, 57 nt, Human
uggauuuucauuuucauguuuuauuuuguaaauauuaucugauguuuggagcuugag

SEQ ID NO: 11931 - RNA, 62 nt, Human; identical to SEQ ID NO: 11929

SEQ ID NO: 11932 - RNA, 57 nt, Human; identical to SEQ ID NO: 11930

SEQ ID NO: 11933 - RNA, 62 nt, Human
aguggcaucaaaugugugacuuacuaucuugggccagaacuaagaaugccaagguuuuauau

SEQ ID NO: 11934 - RNA, 61 nt, Human
uaacauuuacacuuuuguuauaagcuauuuaaaaccaguaaggagacuugaaauucagaaa

SEQ ID NO: 11935 - RNA, 62 nt, Human
agcaaugauagcaaauaauguacgaauguuuuuugcauucaaaggacauccacaucuguugg

SEQ ID NO: 11936 - RNA, 62 nt, Human; identical to SEQ ID NO: 10475

SEQ ID NO: 11937 - RNA, 62 nt, Human
uuuugggaaguuaauuucuaacuucuuucacugauaaaugaagaaaaguauugcaccuuuga

SEQ ID NO: 11938 - RNA, 62 nt, Human
acgucgcucccuucauuuugggacugaggcugcagcauuggaacaaaagagcauuauuucaa

SEQ ID NO: 11939 - RNA, 62 nt, Human
gugugguaaccuugcgucacggagcuguuagugaacgagguaaaaauaauaaagguacagcc

SEQ ID NO: 11940 - RNA, 61 nt, Human
cauuccauuuuuguguuuguuuuguucuuuucugucacugauccguauuaccacuuuugga

SEQ ID NO: 11941 - RNA, 62 nt, Human
auuacaauucagauccuacuccuuaaagccacaugcgaaggacagccugcagugaccagaga

SEQ ID NO: 11942 - RNA, 57 nt, Human
ucagcggcucaggugccagcucuguucugauucaccagggguccgucaguagucauu

SEQ ID NO: 11943 - RNA, 62 nt, Human
gacagacgagcaccccaugccuauaccucccuccccgagcuaagucccagggcaucugggcc

SEQ ID NO: 11944 - RNA, 60 nt, Human
ccucugugggccuggcagacccuucaugagugggacccaagauaucacugacuucaaccc

SEQ ID NO: 11945 - RNA, 62 nt, Human; identical to SEQ ID NO: 11943

SEQ ID NO: 11946 - RNA, 60 nt, Human; identical to SEQ ID NO: 11944

SEQ ID NO: 11947 - RNA, 62 nt, Human; identical to SEQ ID NO: 11943

SEQ ID NO: 11948 - RNA, 60 nt, Human; identical to SEQ ID NO: 11944

SEQ ID NO: 11949 - RNA, 62 nt, Human; identical to SEQ ID NO: 11943

SEQ ID NO: 11950 - RNA, 60 nt, Human; identical to SEQ ID NO: 11944

SEQ ID NO: 11951 - RNA, 62 nt, Human
gucccacggcagaagcccugaggacugacuccugggggagaacagcauucccgccgccucca

SEQ ID NO: 11952 - RNA, 60 nt, Human; identical to SEQ ID NO: 11810

SEQ ID NO: 11953 - RNA, 62 nt, Human
gaacaccccagcggagaaaacagcauuauauacaucggaguaucauuuuaggauucaagugu

SEQ ID NO: 11954 - RNA, 60 nt, Human
ugcagcacagugcuggcccuaaugccaggugagcgugcaaaguccuguuucuuugucuuu

SEQ ID NO: 11955 - RNA, 62 nt, Human
aacuccuuucccuggcccuccaaacauauauucugugagauaacugugccugcuaccaagug

SEQ ID NO: 11956 - RNA, 56 nt, Human
aucagauuuccaacuuaugccuuccagaaaaaaacacuacugccuaacacaaaucu

SEQ ID NO: 11957 - RNA, 62 nt, Human; identical to SEQ ID NO: 9799

SEQ ID NO: 11958 - RNA, 60 nt, Human
uggcgagacacagcuugagaacagaagggcgucgggggaaccugccgcaaggagcagaga

SEQ ID NO: 11959 - RNA, 62 nt, Human
uuuugagauggagucucuacuaaaaauacaaaaaauuagccaggcauggugccgcauaacua

SEQ ID NO: 11960 - RNA, 62 nt, Human; identical to SEQ ID NO: 9434

SEQ ID NO: 11961 - RNA, 62 nt, Human
cuuccaaugucaagcggaauguuucucucugauaucgaacgaucucuaguuucguagauaug

SEQ ID NO: 11962 - RNA, 62 nt, Human
gagcgugggaggagguggggguggacguccauccggugaacagugaaggcguuugugagguc

SEQ ID NO: 11963 - RNA, 62 nt, Human
cgccucccuccccuccgccagagcugccuguggccagacacacgguggagggaagugcacgc

SEQ ID NO: 11964 - RNA, 62 nt, Human
acuuaaaaugguacucggggaccuccaaagacuaaacugacaagccuucaaggagcccaggg

SEQ ID NO: 11965 - RNA, 62 nt, Human
gccaggcagacugggggcaggacagccggaagcugagaccaaggcuccucacagaagggccc

SEQ ID NO: 11966 - RNA, 60 nt, Human
gcacaccggaaggcugguucuccugccagggucccuuugacauggacagcugcuuaucaa

SEQ ID NO: 11967 - RNA, 62 nt, Human
ccuuguuucucacuuccugguugggcucaucucugaagaacaggucucccagcuucgcuccu

SEQ ID NO: 11968 - RNA, 60 nt, Human
cagauugaagagagaucaugauggucggggccccgggcaagcacauccgcuucugcccag

SEQ ID NO: 11969 - RNA, 62 nt, Human
ucuuggucaccccggccaggccccggaagcagcagccagggaugguccuuccucacccacag

SEQ ID NO: 11970 - RNA, 58 nt, Human
ggcuggcccccgggggagaggggcaaaugccuccgggacugacacuccaggcagcuuu

SEQ ID NO: 11971 - RNA, 62 nt, Human; identical to SEQ ID NO: 10568

SEQ ID NO: 11972 - RNA, 62 nt, Human; identical to SEQ ID NO: 9520

SEQ ID NO: 11973 - RNA, 62 nt, Human
ucacucucucccacccccgggcagcuguuuugcccaagaccacugcuaccuguuuacccacc

SEQ ID NO: 11974 - RNA, 62 nt, Human
uacuggaaacugcugucuaggaccaccugcccuaaccaggaauaaaggcaagacagccugga

SEQ ID NO: 11975 - RNA, 62 nt, Human
gugugucuugcugggggguggugaugauugucucagcacucacgcacugcacaagauggcag

SEQ ID NO: 11976 - RNA, 61 nt, Human
uucuaaauuaugccugcaauuaggcauuggucaggggugaauggcucuuuucacagagagu

SEQ ID NO: 11977 - RNA, 62 nt, Human
acaaagaauacucaagucuuuuucuucuuauggaaucaucgaaacugcuauuuaucauaauc

SEQ ID NO: 11978 - RNA, 62 nt, Human
aaauagguuugucauuuugcaaguuacauaaacauuuaucaaugaagucauccuuuagacuu

SEQ ID NO: 11979 - RNA, 62 nt, Human; identical to SEQ ID NO: 11969

SEQ ID NO: 11980 - RNA, 60 nt, Human; identical to SEQ ID NO: 10788

SEQ ID NO: 11981 - RNA, 62 nt, Human
gcagaggaggggagaagccacacaacaaucuggacccaauaaaguggagagaagggcgucuc

SEQ ID NO: 11982 - RNA, 62 nt, Human
acccguguggguagcacuggaagcggcacuguuugcauuguacauaggaaggaaggaaguuc

SEQ ID NO: 11983 - RNA, 62 nt, Human; identical to SEQ ID NO: 9907

SEQ ID NO: 11984 - RNA, 62 nt, Human
ucuuuucacauaggagggaacagaccauggaaauuuaaacgacuuccucacggucacagaac

SEQ ID NO: 11985 - RNA, 62 nt, Human
ugggugugccagaggacccccagaacuaagaagggagggcgagugggucuccauuccccgag

SEQ ID NO: 11986 - RNA, 62 nt, Human; identical to SEQ ID NO: 11815

SEQ ID NO: 11987 - RNA, 62 nt, Human
ugaacauuuugauacaaauuucaucauuuaaugauucaccaauuucuugcauuaauuugaau

SEQ ID NO: 11988 - RNA, 56 nt, Human
cuuugaucucgcuguaagauuugucaaggcugacuacucacuucuccuuuaaauuc

SEQ ID NO: 11989 - RNA, 62 nt, Human; identical to SEQ ID NO: 10761

SEQ ID NO: 11990 - RNA, 62 nt, Human
uggauuaugggagcgguuuucccccaugcuguucucaugauagugagugaguucucacgaga

SEQ ID NO: 11991 - RNA, 62 nt, Human
cuggcgaggccagccggcggcagcacagccugucuccaaucagcaaguggucgugccuggcu

SEQ ID NO: 11992 - RNA, 56 nt, Human
cguggaugagcagucagagagucuacagaacacgcacgacgacagcaggaacaacg

SEQ ID NO: 11993 - RNA, 62 nt, Human
gccaucauaccgccagcgcgacagccaccuggugccaacucacugagccgccugccgcuggg

SEQ ID NO: 11994 - RNA, 62 nt, Human
gauuacaggcgugugccacugcgcucggccucagauuccauauuugaacaccagcugauuga

SEQ ID NO: 11995 - RNA, 62 nt, Human
uuugaaguuuuacagcuuuuuguaaaugcguccugauaaugauuaggaaaaucgaccuuuuc

SEQ ID NO: 11996 - RNA, 60 nt, Human
guauuguuuggaagaaaaaaugaugauagagucccaaaaagaagagaaaaaaaaugccca

SEQ ID NO: 11997 - RNA, 62 nt, Human
guuuuccuuuugcagcacacugggcagucucccuauaaaacaaaaaccccaccuucugugcc

SEQ ID NO: 11998 - RNA, 62 nt, Human
gcuggggugucugcaugucccuucacauaauugauaaugguaccaccuucuauaauaauaau

SEQ ID NO: 11999 - RNA, 62 nt, Human
cccugugaugucccugcauggagcuggugaauuacuaaaagaacauggcauccucugugucg

SEQ ID NO: 12000 - RNA, 59 nt, Human
accgaaaucggccagaagccccucucagguuuauucccaaaauaaaccugucucuguug

SEQ ID NO: 12001 - RNA, 62 nt, Human
cgguguauacuguucuucagcuugucuucucuguguaacauauuuuugagauugucccaugu

SEQ ID NO: 12002 - RNA, 60 nt, Human
acauucggccucauccauaggguccugaagcugcaguccacagcucagaaaggagaggug

SEQ ID NO: 12003 - RNA, 62 nt, Human
uucccucauccuccguggcugccuccaugggacaaggaccgauuccaacacaggcuccucuu

SEQ ID NO: 12004 - RNA, 62 nt, Human
guccagagaaguccuuggaacccugugggaucuagcucguaacuguuuguauuucucuauuc

SEQ ID NO: 12005 - RNA, 62 nt, Human
gacgccaaggaagagaugauguuuaauucaaguccgaaggcaaggaaaaagcugaugguccu

SEQ ID NO: 12006 - RNA, 56 nt, Human
ucgcuaaguacuagaggccgcagacuccuguccgcagccucgcagcuccguggggc

SEQ ID NO: 12007 - RNA, 62 nt, Human
agcaauuaaggaacaagauggaagagaaguggacugggaguauuuuuauggccugcuuuuua

SEQ ID NO: 12008 - RNA, 62 nt, Human
gacacaaaaggccugggacacgaggaguagccagguaggcgacuguuggauagguagggcca

SEQ ID NO: 12009 - RNA, 62 nt, Human; identical to SEQ ID NO: 11101

SEQ ID NO: 12010 - RNA, 62 nt, Human; identical to SEQ ID NO: 11102

SEQ ID NO: 12011 - RNA, 62 nt, Human; identical to SEQ ID NO: 9634

SEQ ID NO: 12012 - RNA, 60 nt, Human
uggccugguccuugcagcuguggcagcagcaggcuccccagcggcccagggugggccaga

SEQ ID NO: 12013 - RNA, 62 nt, Human
ggaggggacccagcuccucugagccauaccgaccaucguccagcccuccuacgcagaugcug

SEQ ID NO: 12014 - RNA, 62 nt, Human
cccagggacaucgugaggauuaacacuugcuaauaucuguaacacaauuuguaaccucucag

SEQ ID NO: 12015 - RNA, 62 nt, Human
acgccuuuaaauaagcaaaaacuuuaaaaggcaggaaagagaauucuuaggcaaauucagag

SEQ ID NO: 12016 - RNA, 59 nt, Human
ggaagauucccagucacccacucacucagaaagccgggagucaucggacaccuugcugg

SEQ ID NO: 12017 - RNA, 62 nt, Human
auuuagaaaauaacuacaaaguaaaaauguagaggaaauagaaauguauuuuuucaugaaca

SEQ ID NO: 12018 - RNA, 57 nt, Human
agccccaaaccuuagccucauuuauuuuguucuguuacauaagucauuuuccccuua

SEQ ID NO: 12019 - RNA, 62 nt, Human
gagucggguuuggggaaguugucaaggaaugagggaaaguaaauccucaugaggaaaaguac

SEQ ID NO: 12020 - RNA, 62 nt, Human
gggggagguucgguagagaaaaauaguaagcugguuuagaaacugacgagggcaaacagcca

SEQ ID NO: 12021 - RNA, 62 nt, Human; identical to SEQ ID NO: 10920

SEQ ID NO: 12022 - RNA, 60 nt, Human
aaauggugcaggcuuagucuuaagccuccaaaggccuggauuugagcagcuuuagaaaug

SEQ ID NO: 12023 - RNA, 62 nt, Human; identical to SEQ ID NO: 9702

SEQ ID NO: 12024 - RNA, 60 nt, Human
caagaaaauccaaacugugucuguuuccuuccagcacuaacaauguccauugcuggaucu

SEQ ID NO: 12025 - RNA, 62 nt, Human
guuuuuucuugguucuggcugccaacugugaguuaaaacucaaggcuuguugugaagccuaa

SEQ ID NO: 12026 - RNA, 58 nt, Human
cagcaagaagggacuguuucuaggugggcugggcgcgagcagggacugucccgagcgg

SEQ ID NO: 12027 - RNA, 62 nt, Human; identical to SEQ ID NO: 9222

SEQ ID NO: 12028 - RNA, 62 nt, Human; identical to SEQ ID NO: 9223

SEQ ID NO: 12029 - RNA, 62 nt, Human
acacaggauuccguuggugaaccuguaaaaacaaaacaaacaaaacaaaacaaaaaagacaa

SEQ ID NO: 12030 - RNA, 62 nt, Human
acgccagugacacguacacaccacguccuggucuuuguuugaggccugacgugggcaucauu

SEQ ID NO: 12031 - RNA, 62 nt, Human
ugucacccccucuacgcucuccuuccucgccagcacgccuuagcuuugcaagccugcaugca

SEQ ID NO: 12032 - RNA, 62 nt, Human; identical to SEQ ID NO: 10490

SEQ ID NO: 12033 - RNA, 62 nt, Human
caggcucuuagagcaggcacaagacugggacacuggacagaagguuguucccaugaugguuu

SEQ ID NO: 12034 - RNA, 62 nt, Human
ugaauugucuucuaaagagauuggauggccucuaaagagguauguguaucuuuauuucagau

SEQ ID NO: 12035 - RNA, 62 nt, Human
caccccaagucuuccagcugguggaucugggcccagcaaagacuguucuccucccgagggaa

SEQ ID NO: 12036 - RNA, 59 nt, Human
cccugccgagauuucaggauaaguuacccccaggcccgaagccccagcuugcccuggcc

SEQ ID NO: 12037 - RNA, 62 nt, Human; identical to SEQ ID NO: 10042

SEQ ID NO: 12038 - RNA, 60 nt, Human
caggagggucccuucuaggacacagaggccaggcgucccaaccccacagucugggggcca

SEQ ID NO: 12039 - RNA, 62 nt, Human
uuuggggcacaacaucccaccgcagucccccucacccgacaacaccuccuaccuggccccuu

SEQ ID NO: 12040 - RNA, 62 nt, Human
auuuggucucgcgacacagggacuauuuucagcacgcccacagugacugccaggacccccca

SEQ ID NO: 12041 - RNA, 62 nt, Human
cuagccaggugcaguccccgccccgccuaguccucggcgucacgcaaugcucaccucgccuc

SEQ ID NO: 12042 - RNA, 61 nt, Human
uccggucaaguucugacuuuuuacaggugugagcgaccacaggccucccaaaguucuggga

SEQ ID NO: 12043 - RNA, 62 nt, Human
gugauugacccuuuaacuguauccuuaaccaccgcauaugcaugccaggcugggcacggcuc

SEQ ID NO: 12044 - RNA, 62 nt, Human
accaaaguagcagugguaggaccugcaacuuuguuacuaguauuugcuuaucacaugacagu

SEQ ID NO: 12045 - RNA, 62 nt, Human
aggccgaggcagguggaucaugaggucaggaguucgaggcgagccuggccaacauggugaaa

SEQ ID NO: 12046 - RNA, 62 nt, Human
cggcaggggugucugaggccgcccugucagcuggccgguccaagccuguggcuggagcuggu

SEQ ID NO: 12047 - RNA, 62 nt, Human; identical to SEQ ID NO: 10384

SEQ ID NO: 12048 - RNA, 62 nt, Human; identical to SEQ ID NO: 9264

SEQ ID NO: 12049 - RNA, 62 nt, Human
ugcaacacgacgcucaccgcggcucgggccguggggccgucagagaaaccuuuuuaaaaaau

SEQ ID NO: 12050 - RNA, 58 nt, Human
agccucaccagcaccuggcagcgagucagagccugugagggcauccgaagcagugaug

SEQ ID NO: 12051 - RNA, 62 nt, Human
ccggccgugguggcaagugccugaaaucccagguacucaggaggcugaggcaggagaaucac

SEQ ID NO: 12052 - RNA, 57 nt, Human
uguacaaucaggaaaagcaauaaagauuuuucaaaaauagacaugucaagaaaguuu

SEQ ID NO: 12053 - RNA, 62 nt, Human
gccccucagcgugccaggcagacugggggcaggacagccggaagcugagaccaaggcuccuc

SEQ ID NO: 12054 - RNA, 62 nt, Human
cugcgcccagccccagaaaucucagugcuguuuggagcuccauuucucauuugaugacuugc

SEQ ID NO: 12055 - RNA, 62 nt, Human; identical to SEQ ID NO: 12053

SEQ ID NO: 12056 - RNA, 62 nt, Human; identical to SEQ ID NO: 12054

SEQ ID NO: 12057 - RNA, 62 nt, Human; identical to SEQ ID NO: 12053

SEQ ID NO: 12058 - RNA, 62 nt, Human; identical to SEQ ID NO: 12054

SEQ ID NO: 12059 - RNA, 62 nt, Human; identical to SEQ ID NO: 12053

SEQ ID NO: 12060 - RNA, 62 nt, Human; identical to SEQ ID NO: 12054

SEQ ID NO: 12061 - RNA, 62 nt, Human
gggaugaucuagccugauuccugcguguccgaaagaacuuaacguuuuaaaggugauuguca

SEQ ID NO: 12062 - RNA, 62 nt, Human
ggugacagaaaaggcagaagcuggggcuuucuggaggauuuaaccacagaggggugggcuuc

SEQ ID NO: 12063 - RNA, 62 nt, Human
cauucuauccuugaugagcaugccagcuaugugguagggccagcccaccaugggggccaaga

SEQ ID NO: 12064 - RNA, 62 nt, Human
uggggacccuaacaggcccagagcagagccccuuaccucccaggucagacuaccugcucagg

SEQ ID NO: 12065 - RNA, 62 nt, Human
aacuuguauuuguuuuaaaaauuaaauuaauccuugauaagaguugcuuuuuuuuuuuagga

SEQ ID NO: 12066 - RNA, 62 nt, Human
uggcaagacacccagaaaggcuauuuucagaugaaaucgauauuagaagcuauauuagcuga

SEQ ID NO: 12067 - RNA, 62 nt, Human
gcuuugacaucuugguguaccucccucauccagcccgucgcagagcauaugcccucuugggg

SEQ ID NO: 12068 - RNA, 62 nt, Human; identical to SEQ ID NO: 11144

SEQ ID NO: 12069 - RNA, 62 nt, Human
gagagguguucgguuuccccagccuguuaaugaacagccauacguguaagcuuuuucuugag

SEQ ID NO: 12070 - RNA, 62 nt, Human
gcuguaauuauuuucuauuuuuguaaacuuguugcuuuuugauaugauuuucuugccugagu

SEQ ID NO: 12071 - RNA, 62 nt, Human
uucagaaaaauguuuuuugagccuacaauacugagcgcaacaaggcuguggagacccauggu

SEQ ID NO: 12072 - RNA, 60 nt, Human
ugccaaaggucuacuuuccagaaucaagugccuucugcaaaucauguuggaaaaguccaa

SEQ ID NO: 12073 - RNA, 62 nt, Human
gaugaccugaacugaaggcgcucccuauuuggucucgcgacacagggacuauuuucagcacg

SEQ ID NO: 12074 - RNA, 62 nt, Human
acacgcgugauugacccuuuaacuguauccuuaaccaccgcauaugcaugccaggcugggca

SEQ ID NO: 12075 - RNA, 62 nt, Human; identical to SEQ ID NO: 10052

SEQ ID NO: 12076 - RNA, 61 nt, Human
aucccagcauuuugggaggcucaggcagacaaaucgcucuagcucagaaguugcagagcag

SEQ ID NO: 12077 - RNA, 62 nt, Human
uuuguaugaguuuggagcagugcugaaggccaaagccgccuacugguuuguaguuaaccuag

SEQ ID NO: 12078 - RNA, 60 nt, Human
aaccccagacaagguugaagcggaagcagccugugcggaaacgccagugacacguacaca

SEQ ID NO: 12079 - RNA, 62 nt, Human
aaaaucuaguuuaauacugcauuauuuauuuuccuaaggcuaaagaggagcaguccuaugcu

SEQ ID NO: 12080 - RNA, 60 nt, Human
aagcaucuuccuuaggucugcccugcuugcaaauccacuagcaccgaccccaccaccugg

SEQ ID NO: 12081 - RNA, 62 nt, Human
gcguccugcucucagacucagaauuaaaccccgguguuggcacugucccaccuuuuucuucu

SEQ ID NO: 12082 - RNA, 62 nt, Human; identical to SEQ ID NO: 10631

SEQ ID NO: 12083 - RNA, 62 nt, Human
aacauuccgguuuucucacaacacauuagcacauacuguccauuagcauaucugggauaacc

SEQ ID NO: 12084 - RNA, 60 nt, Human
agucccguggcagagccuucugggcgcugcgggaacaggagauccucugucgccccugug

SEQ ID NO: 12085 - RNA, 62 nt, Human; identical to SEQ ID NO: 9276

SEQ ID NO: 12086 - RNA, 62 nt, Human; identical to SEQ ID NO: 9527

SEQ ID NO: 12087 - RNA, 62 nt, Human
ggagccggcccgcagcaccugcacacacgaaguccggacccacgcagccuccaucccgcgug

SEQ ID NO: 12088 - RNA, 61 nt, Human
ugcccuggggagcaaucccagcggaucgcuccgggccaccaagccgcaccugugccugaga

SEQ ID NO: 12089 - RNA, 62 nt, Human
uucuggggugaggauacaaagacauugucuugcauauccauaagcaggucuuagagcauuau

SEQ ID NO: 12090 - RNA, 56 nt, Human
cugugccgcccgccaccuucugccauuguuacauuacagauuugguuuaguuuugu

SEQ ID NO: 12091 - RNA, 62 nt, Human; identical to SEQ ID NO: 9276

SEQ ID NO: 12092 - RNA, 62 nt, Human; identical to SEQ ID NO: 9277

SEQ ID NO: 12093 - RNA, 62 nt, Human
gagccagcccucgcgcuggccaggauccuccugccgagcugaugucgcuccugcccucugcc

SEQ ID NO: 12094 - RNA, 58 nt, Human
gucccucugccuguaacaaaucucauuuuuguuaccaagaacuguaugaaagaaguaa

SEQ ID NO: 12095 - RNA, 62 nt, Human; identical to SEQ ID NO: 10320

SEQ ID NO: 12096 - RNA, 62 nt, Human
cuugagcccaggaggcggagguugcagugagcugagauggcaccacuuauugcacuccagcc

SEQ ID NO: 12097 - RNA, 62 nt, Human
gggggucuuccuccaccucccacuuuccaagggcuccaggaaucuggggccugaccacagau

SEQ ID NO: 12098 - RNA, 62 nt, Human
uuccaccccacccccaaccuugucccaagugcccuggacuaaauuuccugugccagugacug

SEQ ID NO: 12099 - RNA, 62 nt, Human
cauacaagcauagacuggauuaaagaaguuuuccaguuccaaaaauuaaaggaauauauccu

SEQ ID NO: 12100 - RNA, 60 nt, Human
uucccagguuacgucugaggaucaguugguguaaagcugagauguuuuuucuugguucug

SEQ ID NO: 12101 - RNA, 62 nt, Human
ggaauuuuauaaguuuuguuacaugaaagguugaaauauugagugguugaaagugaacugcu

SEQ ID NO: 12102 - RNA, 62 nt, Human
gaauaaguauaauuaucauccagccucccagaagaauacucaacaacccuuggccaagcaug

SEQ ID NO: 12103 - RNA, 55 nt, Human
ugguccugcuccgccucugaccgucaguggugggaaccugggcggcucuggaggc

SEQ ID NO: 12104 - RNA, 62 nt, Human; identical to SEQ ID NO: 10039

SEQ ID NO: 12105 - RNA, 62 nt, Human
uccaccauuccgucgagacuuacaggcuuacgcugggcgucaggcuucccagacagagagug

SEQ ID NO: 12106 - RNA, 62 nt, Human
aaaucagaguugcuauaaaauucaguaaaaagcucauagccaaacggcugugcucagaugga

SEQ ID NO: 12107 - RNA, 62 nt, Human
ccaggugggcagccuugagcccaggggacucagugcccuccaugcccuggcuggcagaaacc

SEQ ID NO: 12108 - RNA, 62 nt, Human
ggcugagcuggggcugugugcuugcuaggugugggcgcgcuagugcucguuguagccuuuug

SEQ ID NO: 12109 - RNA, 62 nt, Human
ucacugcugggggcuuccccuucauguggcaccuuugugccaggccaccaggcagacucuuc

SEQ ID NO: 12110 - RNA, 58 nt, Human
cacagauguccguggcgugcgugggcggcugcgcugaagugugaccugaccgugugga

SEQ ID NO: 12111 - RNA, 62 nt, Human
caccccggaaccggcgucgcuggcgcauccuggguggaggcaggccccgagcucggggaagg

SEQ ID NO: 12112 - RNA, 62 nt, Human
acucagauaccagugcuggggagggaggccugacuucagcaacagcugugggugggcuggag

SEQ ID NO: 12113 - RNA, 62 nt, Human
cagcaagcaagcguggcaccaucuuggaucugagccggucgagccccuguccccacccuucc

SEQ ID NO: 12114 - RNA, 58 nt, Human
ggguuagagaagguuugagguagacucugaccgucucauaaaagaguucuacccagca

SEQ ID NO: 12115 - RNA, 62 nt, Human; identical to SEQ ID NO: 10892

SEQ ID NO: 12116 - RNA, 62 nt, Human
guuggcaggagcuccuggaaugcagccuccacuucccucguagcccucacucaagaccaggc

SEQ ID NO: 12117 - RNA, 62 nt, Human
ggggagaugaggguuggguuuuuuuuuuaaugcuacgugacaguuugaaaccuucacaguua

SEQ ID NO: 12118 - RNA, 61 nt, Human
cuuuggggguacgauguuuauacuccguaaagaacauacaaggacauucacugcugauuuu

SEQ ID NO: 12119 - RNA, 62 nt, Human
uuggcgcucucucuuuucugcaugucaaguucugagcgcggacauguuuaccagcacacggc

SEQ ID NO: 12120 - RNA, 60 nt, Human
aggaaagacgaauuaaaaauaacauuuuuuaagcgacauaaggaugaaauacugaugaau

SEQ ID NO: 12121 - RNA, 62 nt, Human
acaccuguggucccaccuauucgggaggcugaagugcgaggaucacuugagcccaggagguu

SEQ ID NO: 12122 - RNA, 62 nt, Human
agaaaaggcagaagcuggggcuuucuggaggauuuaaccacagaggggugggcuucacagga

SEQ ID NO: 12123 - RNA, 62 nt, Human
auuugugcauguauuuuuauaugaaaaaaacuuacaaagauaugcaaauuaaacuucuuuca

SEQ ID NO: 12124 - RNA, 62 nt, Human
caucccaucuccuccucugccgugccuccagacagcgagugagagggcccgcacaccaccca

SEQ ID NO: 12125 - RNA, 62 nt, Human
cucccagguucaagcgauucuccuaccucagcccccagaguagcugggauuacaggcaugua

SEQ ID NO: 12126 - RNA, 62 nt, Human
cacgugaccccacccgcccaccgccacuaucaggccccgggaccgcacugacaggaaaccuu

SEQ ID NO: 12127 - RNA, 62 nt, Human
caagaguccagcaagccagggggaagaugaucccuuugccgaaguguacccucuagccaacu

SEQ ID NO: 12128 - RNA, 62 nt, Human
cugcuaccuguuuacccacccuggucccucccagacaagcaaggccucugauuucuuugaag

SEQ ID NO: 12129 - RNA, 62 nt, Human
uguagcuuaacaccauccacucacuccaacaaagaacacuuagaaugauaaaaaaaaaaaaa

SEQ ID NO: 12130 - RNA, 62 nt, Human
ccgccucugaccgucaguggugggaaccugggcggcucuggaggcccagggcaggggugggc

SEQ ID NO: 12131 - RNA, 62 nt, Human
aggcccauagguauggccccccccuucccccucccaguacuaguuaauuuugaguaauugua

SEQ ID NO: 12132 - RNA, 62 nt, Human
acuaucugcacuccgugacagugguauggaguguggcaaugaguuuggggucuggggcaggg

SEQ ID NO: 12133 - RNA, 62 nt, Human; identical to SEQ ID NO: 12054

SEQ ID NO: 12134 - RNA, 62 nt, Human
ugaagaugcagggcagaggaauugcccauggacagugacgcaaggacuaggcugggagggag

SEQ ID NO: 12135 - RNA, 62 nt, Human
agaggauucaggguuaagcaccaacuaaauuaaaucaugcuauuuaauuuaaguauacauuu

SEQ ID NO: 12136 - RNA, 55 nt, Human
uaaacuggugucuuuggaaggaagguagauacaaaaagauugugguaaaaacugg

SEQ ID NO: 12137 - RNA, 62 nt, Human
caauagcucacugccuacuucccccugcaaaaaucggggcgauccccgaucacuggcauuca

SEQ ID NO: 12138 - RNA, 62 nt, Human
aucuucaaggaucaaaagagacuugccuuuuaaggaucgaaaguacgccaaugugaauuucc

SEQ ID NO: 12139 - RNA, 62 nt, Human
auauuuuuuaaagcacaaaauuggugccaagacugggugagaaauguacauuacccccuuau

SEQ ID NO: 12140 - RNA, 62 nt, Human
aaacaaggaccuuccaguccaggggaaugacugugcaagguaguaucuaagcaccugagaag

SEQ ID NO: 12141 - RNA, 62 nt, Human
aacuccugggcucaagcaauccuccugccucggcuuccuaaaguguugggauuacaggcuug

SEQ ID NO: 12142 - RNA, 62 nt, Human
gggaucucagcacaauuagaaucguaaagugaauucuaucuauuuaauuggauauuggacuc

SEQ ID NO: 12143 - RNA, 62 nt, Human
ucagcucagcccgccaggagucagggaggagacucgcugggagugggagggcagcacgggcg

SEQ ID NO: 12144 - RNA, 59 nt, Human
gucagggccccagccacccaggucaggccgacgccucgacaaaaggaacugaccagagg

SEQ ID NO: 12145 - RNA, 62 nt, Human; identical to SEQ ID NO: 10915

SEQ ID NO: 12146 - RNA, 62 nt, Human; identical to SEQ ID NO: 11223

SEQ ID NO: 12147 - RNA, 62 nt, Human
cucuacuaaaaauacaaaaaauuagccaggcauggugccgcauaacuauaaucccagcuacu

SEQ ID NO: 12148 - RNA, 58 nt, Human
ccugcccugagaaggagccccagacuuaccgauguagacgcugcccuuggcguugacu

SEQ ID NO: 12149 - RNA, 62 nt, Human; identical to SEQ ID NO: 9518

SEQ ID NO: 12150 - RNA, 62 nt, Human; identical to SEQ ID NO: 9519

SEQ ID NO: 12151 - RNA, 62 nt, Human
uuguuuggaagaaaaaaugaugauagagucccaaaaagaagagaaaaaaaaugcccaaguug

SEQ ID NO: 12152 - RNA, 60 nt, Human
cugccugagcaacucuauuucaggugccccacaccggcaaguaccagccagcaacaccaa

SEQ ID NO: 12153 - RNA, 62 nt, Human
ugggagacguccugcacaagucccugcaacuggacgugcagaucgccucggagcacgccucc

SEQ ID NO: 12154 - RNA, 62 nt, Human; identical to SEQ ID NO: 11772

SEQ ID NO: 12155 - RNA, 62 nt, Human
ugaggguuacaguaaccuguugucuuuauauaacuugcaacaaacuaauuuauuuuuuuuuc

SEQ ID NO: 12156 - RNA, 60 nt, Human
gcccaccucaggcccccacccuccacuccuccccacgguacugugaacgucgugugacuc

SEQ ID NO: 12157 - RNA, 62 nt, Human
gcagccucaaaauguuucaaaugccuaccgccucuagaucgagccacguugacuucaggugg

SEQ ID NO: 12158 - RNA, 62 nt, Human
ucauuugucaagaguaaaacccagaagcucugacaggccauaauuucagauccuuuggcuug

SEQ ID NO: 12159 - RNA, 62 nt, Human
gaguaggauuucauuauaaaauuaauagcuaaucuuauucuaucuccugaagauuuaauugc

SEQ ID NO: 12160 - RNA, 62 nt, Human
caagagcaacugauggcugccacuuccaggccccgagagacaggccucacguaacuuuacug

SEQ ID NO: 12161 - RNA, 62 nt, Human; identical to SEQ ID NO: 12069

SEQ ID NO: 12162 - RNA, 59 nt, Human
aaaaacacuacugccuaacacaaaucugugauaacaacaggcugugccuuauuuugaua

SEQ ID NO: 12163 - RNA, 62 nt, Human
ggcaugguuggccggggcgggacguacacugggucgccgcuagcugcaccuucgcacagaug

SEQ ID NO: 12164 - RNA, 62 nt, Human
uuuguuacuaguauuugcuuaucacaugacaguagcugcaaauauuucaaaauaucauuuac

SEQ ID NO: 12165 - RNA, 62 nt, Human
gcgcgguggcucacgccuggaaucucagcgaggccaaggagaguggaucaccugaggucggg

SEQ ID NO: 12166 - RNA, 62 nt, Human
ccgcccccgcccgccugcucggacaguuuccguucccuccuagucucuguucgcucgcuuaa

SEQ ID NO: 12167 - RNA, 62 nt, Human; identical to SEQ ID NO: 10139

SEQ ID NO: 12168 - RNA, 62 nt, Human
aagaagccuauucucuaucuauuuugaaagauuuuggcacuauauuuaauuggaagguaaaa

SEQ ID NO: 12169 - RNA, 62 nt, Human
acacguggacccaguggucaauccugcagagaauucggcggagguuagguuugggaguggag

SEQ ID NO: 12170 - RNA, 62 nt, Human
aucaaagagauucaaagagauuccugcaggccagaggcggaacacaccuuuauggcuggggc

SEQ ID NO: 12171 - RNA, 62 nt, Human
uuuauucagcuugggaaagcuuugugccaugaauacgucgcauuuaauaacaagcaacacac

SEQ ID NO: 12172 - RNA, 62 nt, Human
ugagagccggauccggaguuaccugagggaggugagcuccuaccccuccacggugggugcgg

SEQ ID NO: 12173 - RNA, 62 nt, Human
cacgagccucugcaggugccugcucaccauggcccagcgccacucuguccuccgacucaggu

SEQ ID NO: 12174 - RNA, 62 nt, Human
cuuagcgcuugaccgugccucccagcugcuaacuggccucaaaugaugcaugugaggucagg

SEQ ID NO: 12175 - RNA, 62 nt, Human
caagguaguugaugcccaacugugaagggccguucuaaucuagcauggagguagacaguguu

SEQ ID NO: 12176 - RNA, 62 nt, Human
aaacucaaggcuuguugugaagccuaaaaauauucacaaauaagcuuuuaaacuggugucuu

SEQ ID NO: 12177 - RNA, 62 nt, Human
gcagcggugggaaugucgcaguuggcaacagcgcagagcugaccccucgcagcgaggagaau

SEQ ID NO: 12178 - RNA, 62 nt, Human; identical to SEQ ID NO: 11270

SEQ ID NO: 12179 - RNA, 62 nt, Human; identical to SEQ ID NO: 9340

SEQ ID NO: 12180 - RNA, 58 nt, Human
uucuuuuuccguuuuuccauuuccucacauguccacgagaugcuuggguugcuuuucc

SEQ ID NO: 12181 - RNA, 52 nt, Human; identical to SEQ ID NO: 10498

SEQ ID NO: 12182 - RNA, 62 nt, Human; identical to SEQ ID NO: 10832

SEQ ID NO: 12183 - RNA, 62 nt, Human; identical to SEQ ID NO: 9383

SEQ ID NO: 12184 - RNA, 62 nt, Human
accuucuccagcugaggcaggagaaugccuaccugaccaccaucaccaagcagaucacgccc

SEQ ID NO: 12185 - RNA, 62 nt, Human
aaaacuaggaaaggggaucagaaacauccucuccccgcucuagguuucuucucccaaagggg

SEQ ID NO: 12186 - RNA, 62 nt, Human
gaaucacaggcugcgucugcaccugaaaagugacccgcggaaacucuauggcggauuuuuuu

SEQ ID NO: 12187 - RNA, 62 nt, Human
ccuacugcuaguaacuauuggagcuagaauaauaauaaucgagcguuuacccugggcccagc

SEQ ID NO: 12188 - RNA, 60 nt, Human
ccauccaggugccgcggccagcucucuacaccucuauauauuauauuacuauauagccga

SEQ ID NO: 12189 - RNA, 62 nt, Human; identical to SEQ ID NO: 11217

SEQ ID NO: 12190 - RNA, 58 nt, Human
gguguuucgcuuuucuguaaggauuaagcagauagggagaagggaaaaggggccucac

SEQ ID NO: 12191 - RNA, 62 nt, Human
cgagguggcagcguggagggcucggcguggauggcagccucaggacacacaccccugccuca

SEQ ID NO: 12192 - RNA, 56 nt, Human
agagaaacagcuacugcgugcgugcgcgcacgcauacacacacacacacacacacu

SEQ ID NO: 12193 - RNA, 62 nt, Human
cuuugacaacagugacagccccacaacuaguagccaccuguacauuuguaaacugaccugac

SEQ ID NO: 12194 - RNA, 60 nt, Human
ugugccaauaauaccauuaugugccauguacugacccgaaaggcucggccgcagagccgg

SEQ ID NO: 12195 - RNA, 62 nt, Human
gcccaugggagcaagggcgaguggccgguccccgcugugccaggugggcaggcaggagcaag

SEQ ID NO: 12196 - RNA, 62 nt, Human
cccucauauucauacuugcuugcucaaccacuuaugcaucuauauuuagcuaacaugaguga

SEQ ID NO: 12197 - RNA, 62 nt, Human; identical to SEQ ID NO: 11663

SEQ ID NO: 12198 - RNA, 59 nt, Human
aaggaagaucacauguccccagagaggcacccccaggcaagcucgagggggccacaccg

SEQ ID NO: 12199 - RNA, 62 nt, Human; identical to SEQ ID NO: 12043

SEQ ID NO: 12200 - RNA, 62 nt, Human; identical to SEQ ID NO: 10356

SEQ ID NO: 12201 - RNA, 62 nt, Human
ggaggaaggagagcaauuucuaaguuucaauccugcgcuguacaguugaagaagagugugga

SEQ ID NO: 12202 - RNA, 61 nt, Human
ccugcagccucccacaugccuuaaggggaccguggcccccaccagggacguccugcgccau

SEQ ID NO: 12203 - RNA, 62 nt, Human
guauuucauucucuguaacuucaguucugguguuuuccuugaguaucuacuuggcuucucgu

SEQ ID NO: 12204 - RNA, 60 nt, Human
guacacacggcugugacuugauucaaaagaaaauguuauaagaugcaguaaacuaauaac

SEQ ID NO: 12205 - RNA, 62 nt, Human
uuuucuccucucucugcaucugcgcuuuccagauaagcccaaagacagcaacuucuccacuc

SEQ ID NO: 12206 - RNA, 62 nt, Human
aagcguggcaucgccucgguuucuuacaaaaauucauaauaauauuaauaauaauauacucg

SEQ ID NO: 12207 - RNA, 62 nt, Human
gccacuugggguaaagccagugccagcaauaacaguuuaucaugcucauuaauuugggauuu

SEQ ID NO: 12208 - RNA, 62 nt, Human
ugucuguuggugaaauuuuuauuaaaaggaaaauucuguagaugcacuuauugaauauguga

SEQ ID NO: 12209 - RNA, 62 nt, Human
guuuugccauuuuaacauuucuguauuugaagugcuuaucgaaucuaaaagugacuacuguu

SEQ ID NO: 12210 - RNA, 62 nt, Human
gauguauuugcuugaguuacuccuguaucauugcucauaauauuggaaacuaaaauaaaacc

SEQ ID NO: 12211 - RNA, 62 nt, Human
cacacacaauacacauacaugcauauagacgcaucuauuggaaaugcaguuccacaggugag

SEQ ID NO: 12212 - RNA, 62 nt, Human
cccgaggcagaacaagaggcgcggggccacacccgugaaccaugcagacggccgaagaaguc

SEQ ID NO: 12213 - RNA, 62 nt, Human
gaaaccuuuuuaaaaaauggagaugaauguuacagaauuggacaacccgaacugcuuuucaa

SEQ ID NO: 12214 - RNA, 62 nt, Human
acugaggccuuugcugugaacugcaguguuucauacgaaccaucuuuccuagugcaugagaa

SEQ ID NO: 12215 - RNA, 62 nt, Human
ggaaggggccaggggccugcaggccucccccuggaacugggacuggucucggucugcugacg

SEQ ID NO: 12216 - RNA, 62 nt, Human
acauacccaggucagauugacgggaccagaagggaacaucgacuucuaauccagcuuucuug

SEQ ID NO: 12217 - RNA, 62 nt, Human
guuacaaauuacuagugcuauuuucauuauuauuguaauggaaaaaucuguggacuagaaua

SEQ ID NO: 12218 - RNA, 59 nt, Human
uaaaugacuaacuucuaaaagccccaacacaugacgccaucugaagacccgcaacggag

SEQ ID NO: 12219 - RNA, 62 nt, Human
agagcuuuuuagccaugaagaaucuuucagucauaguacuaauaauuaaauuuucaguauuu

SEQ ID NO: 12220 - RNA, 61 nt, Human
uuuuuuucuuccuauuuuuguuuguuuauacaaauaucugauuugcaagaaaaagugcaug

SEQ ID NO: 12221 - RNA, 62 nt, Human; identical to SEQ ID NO: 10165

SEQ ID NO: 12222 - RNA, 60 nt, Human
guauuuucuaagguugaucaucuuauaccacgaaucguuaauuuugacaguucuacugau

SEQ ID NO: 12223 - RNA, 62 nt, Human
agcgcuucccccaucuggugaugcuugagugcacagagaccaacucccugggcuucauacug

SEQ ID NO: 12224 - RNA, 62 nt, Human
ugugugucauacaagcauagacuggauuaaagaaguuuuccaguuccaaaaauuaaaggaau

SEQ ID NO: 12225 - RNA, 62 nt, Human
gaacaaaagcaaagcauuaguggcuauggucuguaaaaugaaacaaaaaaacuuuauuucac

SEQ ID NO: 12226 - RNA, 53 nt, Human
ccaauauuuauuuauugagaguuuuuuagugcaaucugggccaguauuuuuau

SEQ ID NO: 12227 - RNA, 62 nt, Human
auuuuuaaauuuuuauuuuaauaaagcuaaucaauuucuacaaccuugucacauguagcuga

SEQ ID NO: 12228 - RNA, 60 nt, Human
uuggaggauuucuuggaagagcauuuauggagauacuuaagggagguagcaaagauuuga

SEQ ID NO: 12229 - RNA, 62 nt, Human; identical to SEQ ID NO: 9412

SEQ ID NO: 12230 - RNA, 62 nt, Human
guauuuagacuuaggaaaaaaggcagaguaacauuacuuaaaaaaaaaaggauauguuuaca

SEQ ID NO: 12231 - RNA, 62 nt, Human
acuaacaucccagacuuuaaaauucaguaaaucagauguacaccgagccugcagucucgcua

SEQ ID NO: 12232 - RNA, 61 nt, Human
caccacagccuucuccagagccggcacugucccggcaaccaggggugccccaggcuagcuc

SEQ ID NO: 12233 - RNA, 62 nt, Human
acgcuccuguggugagggcagggugcuccacagacaccuccagacccagccaagaacuacag

SEQ ID NO: 12234 - RNA, 62 nt, Human; identical to SEQ ID NO: 10508

SEQ ID NO: 12235 - RNA, 62 nt, Human
gagucaggccugggcaggacccugcugacucguggcgcgggagcugggagccaggcucuccg

SEQ ID NO: 12236 - RNA, 62 nt, Human
ccagggcccugcagaggggaaaccaguguagccuugcccggauucugggaggaagcagguug

SEQ ID NO: 12237 - RNA, 62 nt, Human
uaauuuuuuugccuuacuuucaugugcaaugagaauuacuuaagaauugguaacgcauguag

SEQ ID NO: 12238 - RNA, 59 nt, Human
agugaaggcguuugugaggucuuucuggucccagcaugaaauaaagccuuggccugggg

SEQ ID NO: 12239 - RNA, 62 nt, Human
guaucccucugccacaccccaggcccugcgaggggcuaucgagaggagcucacugugggaug

SEQ ID NO: 12240 - RNA, 62 nt, Human
uagaaccugcuauauuaucaagcuuaccuacuguuaucucuaaaauuuuuuuuguguuaaug

SEQ ID NO: 12241 - RNA, 62 nt, Human
uuucugguacccaguauauuggagucugucagaaacucuauaauaggccaccaguuuuuauu

SEQ ID NO: 12242 - RNA, 62 nt, Human
gccuguccgcugcagccgcacccuaccuugucuaagaaaccaugugugucuggaacacgcug

SEQ ID NO: 12243 - RNA, 62 nt, Human; identical to SEQ ID NO: 11749

SEQ ID NO: 12244 - RNA, 60 nt, Human
auugggacgucugcacuugagcuucuacaaucugauauaaaucugaauacaggauuauuc

SEQ ID NO: 12245 - RNA, 62 nt, Human; identical to SEQ ID NO: 9536

SEQ ID NO: 12246 - RNA, 62 nt, Human
gcucgaagagcaaaaugauuauuccucauguuuuagcugaaauuaauuuuaaaacauauuaa

SEQ ID NO: 12247 - RNA, 62 nt, Human
ugcugcgaacagcauaggugagacucugccgagugagguauaggucuucucaccacgccugu

SEQ ID NO: 12248 - RNA, 62 nt, Human
gaaguucccggccugggggcuuuauccaggggucccagucgagaguggcccgaggccguccc

SEQ ID NO: 12249 - RNA, 62 nt, Human
ggacacuuggaaacuaaaaccuaggucuuagguacauccuaaagggagcacagaacccauca

SEQ ID NO: 12250 - RNA, 62 nt, Human
ccaccacaaccuccagccucccuuuucagagcacagcauuaaaguuuggggaauucuguaga

SEQ ID NO: 12251 - RNA, 62 nt, Human
accaggcgggggccucaccgccccagggccguugccugcucagaccuugcaggcuguggagc

SEQ ID NO: 12252 - RNA, 62 nt, Human
guagacgcaggcggcagaggugcuggaccacaucuccgccaagucacugcccagcagccuuc

SEQ ID NO: 12253 - RNA, 62 nt, Human
agaagacauggccagggaaggcgaggaagccaucaucguggaaauaggcuccguacugccca

SEQ ID NO: 12254 - RNA, 61 nt, Human
ugagugugggguggggaagucccuucccaacggaggucccagccuauggcccugggcccag

SEQ ID NO: 12255 - RNA, 62 nt, Human
ugggaggccuggcagucuucaugcugcccugcugcugcuggaaggauggggaucuuucaccu

SEQ ID NO: 12256 - RNA, 60 nt, Human
ugcaggcgggaagccaggcggguggagcccaugggagcaagggcgaguggccgguccccg

SEQ ID NO: 12257 - RNA, 62 nt, Human
aggcuguccccagcggugacgggagguguccuggcugcuccaggacaaaagacaaucgucuc

SEQ ID NO: 12258 - RNA, 60 nt, Human
ugagcccaggaguucaagacuagccugggcaacacggcgaaaccucgucucuacaaaaaa

SEQ ID NO: 12259 - RNA, 62 nt, Human; identical to SEQ ID NO: 12257

SEQ ID NO: 12260 - RNA, 60 nt, Human; identical to SEQ ID NO: 12258

SEQ ID NO: 12261 - RNA, 62 nt, Human
uuacaaaaauucauaauaauauuaauaauaauauacucgacauugucgggcuggggcguggc

SEQ ID NO: 12262 - RNA, 62 nt, Human; identical to SEQ ID NO: 11689

SEQ ID NO: 12263 - RNA, 62 nt, Human
ccacuuauugcacuccagcccgggcgacagagcgagacuccaucuaccagauccuuaugacg

SEQ ID NO: 12264 - RNA, 60 nt, Human
accucucuuccauagcaaugggaaagugaugagugcgggaguccugaggagauguggccu

SEQ ID NO: 12265 - RNA, 62 nt, Human
agagauuucuuguccccucucaggucauguguagaugcgauaaaucaagugauuggugugcc

SEQ ID NO: 12266 - RNA, 61 nt, Human
gugagaaaauauuugaaagggauuauauuaauugcuaaauauuuuauucacaaaggucaau

SEQ ID NO: 12267 - RNA, 62 nt, Human
ggccugagcagcuggaucugguacaaagcaaucggacauagaguuggagggggaggccccug

SEQ ID NO: 12268 - RNA, 58 nt, Human
ucccuguuucaaauguguucagaggaaauagaauguaaaacaucacaaaaaaaauugc

SEQ ID NO: 12269 - RNA, 62 nt, Human; identical to SEQ ID NO: 9308

SEQ ID NO: 12270 - RNA, 60 nt, Human
aauacacguaaucuuuuugaagcagacauuguauacagaaucuuacuucucuuuguuccu

SEQ ID NO: 12271 - RNA, 62 nt, Human
accccagugauuggguagcagcucacaucccacccagcuucacaagugaggaacccaggugc

SEQ ID NO: 12272 - RNA, 60 nt, Human
uagggauuucauguuaucauuuuuaaauaaaguauaacuaugugucucagcuugggcugc

SEQ ID NO: 12273 - RNA, 62 nt, Human
ucucuuucuauuccccagugaacugagguuuuuaccgauuuauagagcagucaaauccgaag

SEQ ID NO: 12274 - RNA, 62 nt, Human
uuaugaugaaguaaguguuaagugucagauaaauagcacacagaauaguucuuucugcuggu

SEQ ID NO: 12275 - RNA, 62 nt, Human
ucugcuuucaggaaagguuuauuguggugagugccuucuguacagucgacugcaaaugaaac

SEQ ID NO: 12276 - RNA, 59 nt, Human
uguuggaagacuuuuaagugaguuuuuguucuuagauaacccacauuagaugaaugugu

SEQ ID NO: 12277 - RNA, 62 nt, Human
uuuggcauuaauuauauaucacugccacccucugaacuuugaaaacugccaucuucagacuu

SEQ ID NO: 12278 - RNA, 60 nt, Human
cauacgcgggugccccuucgccucccuccccuccgccagagcugccuguggccagacaca

SEQ ID NO: 12279 - RNA, 62 nt, Human
guugcuuuuugauaugauuuucuugccugaguguuggccggagggacugcuggcccggccuc

SEQ ID NO: 12280 - RNA, 62 nt, Human
cccaauuuaagagggucauuuccaucucaggggacucccggauggguguuuccgcucucaau

SEQ ID NO: 12281 - RNA, 62 nt, Human; identical to SEQ ID NO: 10089

SEQ ID NO: 12282 - RNA, 62 nt, Human
cggggaggaaaggcuaaagcugcuggcccggggcccacaggaggggcuucgaggcuggcccu

SEQ ID NO: 12283 - RNA, 51 nt, Human
ucuccccagcacaugauuaaguaccgguacaucccguucacacaugggaag

SEQ ID NO: 12284 - RNA, 62 nt, Human
uucugaccgcuuuuucuugguuaugaaucuuaauuucgaauauaagaugauagguaagcgca

SEQ ID NO: 12285 - RNA, 62 nt, Human
ccccaccagggacguccugcgccauccguucacgucucugcauccauuccuucaugucuuua

SEQ ID NO: 12286 - RNA, 62 nt, Human
ugagacagagucucugucgcccaggcuggagcccaguggcgagaucuuggcucacuacaacc

SEQ ID NO: 12287 - RNA, 62 nt, Human; identical to SEQ ID NO: 9490

SEQ ID NO: 12288 - RNA, 62 nt, Human
gauggcagaacgaugccugcaggcauggaacuuuuuccguuaucacccaggccugauucacu

SEQ ID NO: 12289 - RNA, 62 nt, Human
uacaaaaguccauaaaaugugaaaacuggagaagaucuuagagguugaagcccaccuucucu

SEQ ID NO: 12290 - RNA, 62 nt, Human
uuuucccggcguuuuaggaucuguacauagagaaauauuuaaauuuuuagaagcaaaacuua

SEQ ID NO: 12291 - RNA, 62 nt, Human
caagcuuuuaaaggugcauuuaagaauccaugugacuuuagaauggaacugccggcccuggc

SEQ ID NO: 12292 - RNA, 59 nt, Human
augggccagcaauaccugcuuuucugaagcccccaaggagggcucugacauucuuuuua

SEQ ID NO: 12293 - RNA, 62 nt, Human; identical to SEQ ID NO: 11536

SEQ ID NO: 12294 - RNA, 60 nt, Human
ccuuucagguaagcaaauuaaaguucaguuugcucaucgacauuuggucuggucccucau

SEQ ID NO: 12295 - RNA, 62 nt, Human
cccucgugcugugucccgcucggguuccaauggacaguaucagggcuuguuugacuuagguc

SEQ ID NO: 12296 - RNA, 62 nt, Human
auuugcguuucaguuacauuugcauuuaagacaaguguucuauuuauuucuuguauuguuug

SEQ ID NO: 12297 - RNA, 62 nt, Human
agguagggacugcagguagggccuguuauguccaucauugcaugcguccauaccagggcugc

SEQ ID NO: 12298 - RNA, 60 nt, Human
agugagcugagaucgcgccacugcacuccagccggggugacagagccagacccugucuca

SEQ ID NO: 12299 - RNA, 62 nt, Human
gcuccagcagcccaggaggcgaggaaggcugggcgagcucuagcccuaagggagugccguuc

SEQ ID NO: 12300 - RNA, 62 nt, Human
cuucagcucuaggacuuguagcuuuaagcaaacgguguggcauggguugaguguggccaccu

SEQ ID NO: 12301 - RNA, 62 nt, Human
gacucuugugugcccuuuagacaggcuggccugccgguuccacaggguacaguuaggacuug

SEQ ID NO: 12302 - RNA, 62 nt, Human
uguacugcuugugugugugcgugaguguguguguguguaugaguguguguuccgccucccac

SEQ ID NO: 12303 - RNA, 62 nt, Human; identical to SEQ ID NO: 12301

SEQ ID NO: 12304 - RNA, 62 nt, Human; identical to SEQ ID NO: 12302

SEQ ID NO: 12305 - RNA, 62 nt, Human
accuaacagccacguucacauuuacguagcugguugcuuacaaacgggccugagccccuggu

SEQ ID NO: 12306 - RNA, 62 nt, Human
cuaccaugauugcuuuugagggcccggaauuauaaauauauauuauauuuuaauuguuugag

SEQ ID NO: 12307 - RNA, 62 nt, Human
ccuuguguguguguguugaucccaagacaaugaaaguuugcacuguaugcuggacggcauuc

SEQ ID NO: 12308 - RNA, 60 nt, Human
aagaaaaccacccacaagcucaacugugacccaagcagaaucuacaaaccccagacaagg

SEQ ID NO: 12309 - RNA, 62 nt, Human
uaaggaacaagauggaagagaaguggacugggaguauuuuuauggccugcuuuuuaccucag

SEQ ID NO: 12310 - RNA, 60 nt, Human
auugcuaaauauuuuauucacaaaggucaauaacauggcaagauaaaauuauuuguauag

SEQ ID NO: 12311 - RNA, 62 nt, Human
ucuucugcgaaagaguaaggugugugcuuuuuuuuuuuugcaauaugaccccgucucucuga

SEQ ID NO: 12312 - RNA, 60 nt, Human
gcuuuuaaacuggugucuuuggaaggaagguagauacaaaaagauugugguaaaaacugg

SEQ ID NO: 12313 - RNA, 62 nt, Human
cugccccaaggcucuuuacugaugucagaaucauuguuugcaccugcuggguauggccuuug

SEQ ID NO: 12314 - RNA, 57 nt, Human
cauuccaacuaaucaucaucuucaaguuuuccaccaagguaccuacauucuaccacg

SEQ ID NO: 12315 - RNA, 62 nt, Human
cucucuggaucaggcagauauaaacuuucuagcgcauuuugagagagggcuuucuuggguga

SEQ ID NO: 12316 - RNA, 61 nt, Human
uuacuaucuugggccagaacuaagaaugccaagguuuuauauauguguguguauauauaua

SEQ ID NO: 12317 - RNA, 62 nt, Human
uguggcuccccuucugauucaguauuuugcauggggguuagagaagguuugagguagacucu

SEQ ID NO: 12318 - RNA, 54 nt, Human
gucccuuuaggaauaauccaggaagugucccggaaaagagagagaagacaucag

SEQ ID NO: 12319 - RNA, 62 nt, Human
ucuugguuaugaaucuuaauuucgaauauaagaugauagguaagcgcagcuuucuuggauaa

SEQ ID NO: 12320 - RNA, 62 nt, Human
caggagaggagcgggaccuguggcucuacaacugaguccuuaaacagggcaucuccaggaag

SEQ ID NO: 12321 - RNA, 62 nt, Human
acucggaugggcuuuaaauuauucccauaggggccaauuucaaauaauaauuuuuuucccug

SEQ ID NO: 12322 - RNA, 61 nt, Human
gagcccgggaaguggagguugcacugagcugagaccauggaauugcacugcagcaugggca

SEQ ID NO: 12323 - RNA, 62 nt, Human
uuuuuuuuuuuucuuuuuuuaggcauauguaguaauauuagaaacauuuaauuugggaaacu

SEQ ID NO: 12324 - RNA, 53 nt, Human
guuuuaagucauauauuuucgucccccugaaaaugauggcaagcccaguuucu

SEQ ID NO: 12325 - RNA, 62 nt, Human; identical to SEQ ID NO: 11207

SEQ ID NO: 12326 - RNA, 62 nt, Human
auuaugcuuuuaaaucauccaauaagagaugcucaucgacgaccuacugccaauaaagggaa

SEQ ID NO: 12327 - RNA, 62 nt, Human
uggacuugcggggaggaaacuccagggcacugcaucuggcgaucagacucugagcacugccc

SEQ ID NO: 12328 - RNA, 62 nt, Human
gaacugagguuuuuaccgauuuauagagcagucaaauccgaagugcucgagugcuuagaaac

SEQ ID NO: 12329 - RNA, 62 nt, Human
aucuuuacagaggaacuguaguucacauccaccugucugacauuguccccuaaaaacaagug

SEQ ID NO: 12330 - RNA, 62 nt, Human
uuucuuuugaaaucuaguuuugaauaagucugggugaccgcaccuaaaaugguaagcaguac

SEQ ID NO: 12331 - RNA, 62 nt, Human
ccgaacccggagcggaggcgcccaacccggcagacgggugcaggcccggccuuuccccacgc

SEQ ID NO: 12332 - RNA, 61 nt, Human
cgcgugccccgugugcuggugcgguucccaucacgcagacaggaaggguguuugcgcacuc

SEQ ID NO: 12333 - RNA, 62 nt, Human; identical to SEQ ID NO: 9925

SEQ ID NO: 12334 - RNA, 62 nt, Human; identical to SEQ ID NO: 9731

SEQ ID NO: 12335 - RNA, 62 nt, Human
gaggaauuugccaaagaucuacccugagauaacgccuguccagugucuucaccacgugaaua

SEQ ID NO: 12336 - RNA, 59 nt, Human
aggacgagccauuucugggcacguggcagcagucgcugaucucccagcugaggggcuga

SEQ ID NO: 12337 - RNA, 62 nt, Human
caucugcgaaccagggugaagucacaggucccgggguguggaggcuccauccuuucuccuuu

SEQ ID NO: 12338 - RNA, 60 nt, Human
cgcaccacagggcagcacgggagacguugacaccaccggacgagaaagaaaaaagagaga

SEQ ID NO: 12339 - RNA, 62 nt, Human
guccuccucccagcuaccccuuuauaguaugacgaguuaacaaguuggugaccugcacaaag

SEQ ID NO: 12340 - RNA, 62 nt, Human
ugacucugccgagugcccucacucgccuucgagagauaaagaaagcguuaccucucauuucu

SEQ ID NO: 12341 - RNA, 62 nt, Human; identical to SEQ ID NO: 11124

SEQ ID NO: 12342 - RNA, 57 nt, Human
gaggguggugccauaccugcugcaucaggcaucaaaaucccccgucaguuccccuga

SEQ ID NO: 12343 - RNA, 62 nt, Human
gcugggaacuuacccacuguaaucaccuaaauaaaguguuuauaaacaugauuguggcaccu

SEQ ID NO: 12344 - RNA, 60 nt, Human
uagaugcagauauucuauacaguucuguugucuuuuacuaggacuguaaacuuuugugau

SEQ ID NO: 12345 - RNA, 51 nt, Human; identical to SEQ ID NO: 12283

SEQ ID NO: 12346 - RNA, 60 nt, Human
ugaaauucacaccccugcagaucagaaaaaacaaauagaagaaaaugaggguuacaguaa

SEQ ID NO: 12347 - RNA, 62 nt, Human
cagaauagaaaagaaacgcaccaucauuccuacacugguggaagcaauuaaggaacaagaug

SEQ ID NO: 12348 - RNA, 60 nt, Human
gaucuggguguccugacccucagcuggcccugcccagccacccuggacgugaccguaucc

SEQ ID NO: 12349 - RNA, 62 nt, Human; identical to SEQ ID NO: 10003

SEQ ID NO: 12350 - RNA, 55 nt, Human
uuugacuuuuacuaaguuguuaaauaaaguuauaauacagcugugaagggcuaaa

SEQ ID NO: 12351 - RNA, 62 nt, Human
caauuuguauugagccaaauuaggaaacagacaguaacgucaaggaaguagauacuggcugg

SEQ ID NO: 12352 - RNA, 60 nt, Human
cagccugucuccaaucagcaaguggucgugccuggcucuagagagcguggggagcugguc

SEQ ID NO: 12353 - RNA, 62 nt, Human
aggaaguagguuuaaagccuaccaguguaaccuaccaguacaacugugaauccuaggcaagg

SEQ ID NO: 12354 - RNA, 55 nt, Human
agauguccguggcgugcgugggcggcugcgcugaagugugaccugaccgugugga

SEQ ID NO: 12355 - RNA, 62 nt, Human
cguagaguggcacaugcuuacagggcauuggugccaaguccaguggaugagaauccagcccc

SEQ ID NO: 12356 - RNA, 62 nt, Human
cguuuccauaucuccugcuggaaaucagaaaauauaauaaaauugcacaaaaaaaaaaauga

SEQ ID NO: 12357 - RNA, 62 nt, Human
uuugugauuuuuagcuaaagagagggaaccucaucuaaguaacauuugcacaugauacagca

SEQ ID NO: 12358 - RNA, 62 nt, Human
ccauuaugugccauguacugacccgaaaggcucggccgcagagccggggcccagcgaaucac

SEQ ID NO: 12359 - RNA, 62 nt, Human
gggcaggggugggggugcauccucaggagggcucccccuuuacuggucucccuucccuucuc

SEQ ID NO: 12360 - RNA, 62 nt, Human
gaagagccucuacugaaaaauauggaucaucacagauccaaacagaaaaaugggggcgaugu

SEQ ID NO: 12361 - RNA, 62 nt, Human
cggucugggguugggacguguaagcgccugggagagccuagaccaggcuccgggcugccaau

SEQ ID NO: 12362 - RNA, 60 nt, Human
aagggaugccaguaagucugcaggugcggggugccaccuacaggcccaggccuguguccc

SEQ ID NO: 12363 - RNA, 62 nt, Human; identical to SEQ ID NO: 12361

SEQ ID NO: 12364 - RNA, 60 nt, Human; identical to SEQ ID NO: 12362

SEQ ID NO: 12365 - RNA, 62 nt, Human
gacccaagcccacgucaggagaggagcguggggucagcuccagcagggucggggucagugcc

SEQ ID NO: 12366 - RNA, 51 nt, Human
ccacaggcuccacugagugaagcccucaucaaagacucaggaggccccugg

SEQ ID NO: 12367 - RNA, 62 nt, Human
acucuuucuuuccaaucaauuuauacaaaagaggucgcuccagcccuaccacaggucugacu

SEQ ID NO: 12368 - RNA, 61 nt, Human
cagggggccgccugugcuuucuuaugcugggcucccuggcagcagguaguggcagccucua

SEQ ID NO: 12369 - RNA, 62 nt, Human
gcaggagguagggacugcagguagggccuguuauguccaucauugcaugcguccauaccagg

SEQ ID NO: 12370 - RNA, 62 nt, Human
cacacccuucaggcugcacccgggcaggccucagaacggugaggggccagggcaaagggugu

SEQ ID NO: 12371 - RNA, 62 nt, Human; identical to SEQ ID NO: 10736

SEQ ID NO: 12372 - RNA, 60 nt, Human
ggccagccggacacaagcggcccugacacgugauggaccaaagccaccugcugcggggga

SEQ ID NO: 12373 - RNA, 62 nt, Human
agguggguggugcaggcgguggagggacacaggccagcucaagcccgcugguggcagggcgu

SEQ ID NO: 12374 - RNA, 60 nt, Human
cuggaaggauggggaucuuucaccuuuagggaucucagcacaauuagaaucguaaaguga

SEQ ID NO: 12375 - RNA, 62 nt, Human; identical to SEQ ID NO: 9907

SEQ ID NO: 12376 - RNA, 62 nt, Human; identical to SEQ ID NO: 9908

SEQ ID NO: 12377 - RNA, 62 nt, Human; identical to SEQ ID NO: 9592

SEQ ID NO: 12378 - RNA, 62 nt, Human
agggggagguucgguagagaaaaauaguaagcugguuuagaaacugacgagggcaaacagcc

SEQ ID NO: 12379 - RNA, 62 nt, Human
accagaaaaccuuguuaacguauaacuuguuccaguacuacaucucugccugcuggcucaug

SEQ ID NO: 12380 - RNA, 56 nt, Human
gcugcccuaggugugcuggaaguccacuuggaagaacuguuccggaggcgcugggu

SEQ ID NO: 12381 - RNA, 62 nt, Human
uauguuuguguguguauauauauguuuguguauauauauacacauaugcauacauaugauuu

SEQ ID NO: 12382 - RNA, 57 nt, Human
ucuguacauagagaaauauuuaaauuuuuagaagcaaaacuuauacaacauuaaaau

SEQ ID NO: 12383 - RNA, 62 nt, Human
gagaaggucagauuagggcggggagaagagcauccggcaugagggcugagaugcgcaaagag

SEQ ID NO: 12384 - RNA, 62 nt, Human
agccacugcaccugaccugcugaauuguuuauaauggcaagaaauaggaaaccccccaaugu

SEQ ID NO: 12385 - RNA, 62 nt, Human; identical to SEQ ID NO: 9512

SEQ ID NO: 12386 - RNA, 62 nt, Human; identical to SEQ ID NO: 9737

SEQ ID NO: 12387 - RNA, 62 nt, Human; identical to SEQ ID NO: 11678

SEQ ID NO: 12388 - RNA, 59 nt, Human
ggcauacccaccuggccggaggagcccgauugggguuaauuuuaucuucacguagcagc

SEQ ID NO: 12389 - RNA, 62 nt, Human
auaccaaauguaaucuuuccaaugcuccaaugaauuuauacaugagauugauaugcaauaaa

SEQ ID NO: 12390 - RNA, 60 nt, Human
gcugggcuccgaacggccucucagaagagccucuacugaaaaauauggaucaucacagau

SEQ ID NO: 12391 - RNA, 62 nt, Human; identical to SEQ ID NO: 12381

SEQ ID NO: 12392 - RNA, 61 nt, Human
cuagugacccucucaucacuguaaccaucgcgccuggccuagaugucguguuuuggaugcu

SEQ ID NO: 12393 - RNA, 62 nt, Human
cuucuuccuuugaauucucuaaaauaggcagcuaacggauuauauacuucaggguuuggcuu

SEQ ID NO: 12394 - RNA, 62 nt, Human
cugccauugucuaagccaccucugaaagcagguuuuaacaaaaggaugaggccagaacucuu

SEQ ID NO: 12395 - RNA, 62 nt, Human
gcccugccucccaccgcuuuauuucuuucgguuucggaugcaaaacaaaaaauuuuaaaaga

SEQ ID NO: 12396 - RNA, 61 nt, Human
gggccguugccugcucagaccuugcaggcuguggagcaagaggcccugggucucuccaagc

SEQ ID NO: 12397 - RNA, 62 nt, Human
acacuuuccugagaugcacuuacuucucagcuucugcgaucagauuaucaucaccaccaccc

SEQ ID NO: 12398 - RNA, 61 nt, Human
agaaaggauuucucuuccaagaggaaauagacuuagacgaaaaugagucaagugacaacag

SEQ ID NO: 12399 - RNA, 62 nt, Human
cagaagagccucuacugaaaaauauggaucaucacagauccaaacagaaaaaugggggcgau

SEQ ID NO: 12400 - RNA, 62 nt, Human
cccccuggccacugccaagagaaugaagcacccagucucguaccauuuugagcccuccagca

SEQ ID NO: 12401 - RNA, 62 nt, Human; identical to SEQ ID NO: 9254

SEQ ID NO: 12402 - RNA, 62 nt, Human; identical to SEQ ID NO: 9750

SEQ ID NO: 12403 - RNA, 62 nt, Human
acuuccucauucauugagcuuuuuaaaagaucacaaccucaagaugguuaaaauccauugac

SEQ ID NO: 12404 - RNA, 62 nt, Human
cgcucccuucauuuugggacugaggcugcagcauuggaacaaaagagcauuauuucaauuuu

SEQ ID NO: 12405 - RNA, 62 nt, Human
gcaaauaauguacgaauguuuuuugcauucaaaggacauccacaucuguuggaagacuuuua

SEQ ID NO: 12406 - RNA, 58 nt, Human
auucaugcuuaucuucccccaccuucuacaugguauuagucccagcaggcaucccugg

SEQ ID NO: 12407 - RNA, 62 nt, Human
ccagcgucuacgacggcaaguaccugccugcggccaacaugauggcugggcugagcagccug

SEQ ID NO: 12408 - RNA, 56 nt, Human
gccccagguccuggcccagucccuccacugccucgaagagucagucugcccugccu

SEQ ID NO: 12409 - RNA, 62 nt, Human
ugggugguggauucuuggacgugugugucauacaagcauagacuggauuaaagaaguuuucc

SEQ ID NO: 12410 - RNA, 60 nt, Human
ccucccugggcacaugugcacacgugcccaggcacaaguaugucucugggucccuugccc

SEQ ID NO: 12411 - RNA, 62 nt, Human
cccacggcccagcagacaugcgagcuuccagagugcaaucuaugugaugucuuccaacguua

SEQ ID NO: 12412 - RNA, 62 nt, Human; identical to SEQ ID NO: 11730

SEQ ID NO: 12413 - RNA, 62 nt, Human
aaaagugagaaaauauuugaaagggauuauauuaauugcuaaauauuuuauucacaaagguc

SEQ ID NO: 12414 - RNA, 62 nt, Human
cagaccaugaucugcagcaagaaacgugccuuccaucauaaaucaguccauuuguuuacaac

SEQ ID NO: 12415 - RNA, 62 nt, Human
cuauuuaaaaccaguaaggagacuugaaauucagaaaaucaacacauuuuuaaaugacuaac

SEQ ID NO: 12416 - RNA, 61 nt, Human
guaugggugaccgucccugagacauaagcgagguagauucagccauccucacccucagacu

SEQ ID NO: 12417 - RNA, 62 nt, Human; identical to SEQ ID NO: 10791

SEQ ID NO: 12418 - RNA, 60 nt, Human
uuaaggggaccguggcccccaccagggacguccugcgccauccguucacgucucugcauc

SEQ ID NO: 12419 - RNA, 62 nt, Human; identical to SEQ ID NO: 10155

SEQ ID NO: 12420 - RNA, 62 nt, Human
ucaucaggauuuuggguuuuucacauuucacgcuaaggaguaguggcccugacuuccggucg

SEQ ID NO: 12421 - RNA, 62 nt, Human
uuugcugagccucuggcccugccgagauuucaggauaaguuacccccaggcccgaagcccca

SEQ ID NO: 12422 - RNA, 60 nt, Human
acgagggaugcugagcccuggugucagagucguaauuuaaagcguguguguauauggacu

SEQ ID NO: 12423 - RNA, 62 nt, Human; identical to SEQ ID NO: 10534

SEQ ID NO: 12424 - RNA, 62 nt, Human
ggagcuccucccccuucugggagcuccucccccuccccagaaggccaagggaugugggggcu

SEQ ID NO: 12425 - RNA, 62 nt, Human
cccauccuuuucugcuccaaccugccccacugggucccggcaggggccaugccuaccaagcu

SEQ ID NO: 12426 - RNA, 58 nt, Human
uccagccugguuacagagcaagacucugucucaaacaaaacaaaacaaaacaaaaaca

SEQ ID NO: 12427 - RNA, 62 nt, Human; identical to SEQ ID NO: 9929

SEQ ID NO: 12428 - RNA, 62 nt, Human
auauaugcaauucauauacuuggacuuguugaaugcgaacgaccuuuguuuuccugcauaaa

SEQ ID NO: 12429 - RNA, 62 nt, Human
cccucagcuccuguuccuuggugccagcagcuggggcagggaagggugggaggggccccauc

SEQ ID NO: 12430 - RNA, 62 nt, Human
ucacguugaaccacgugaaacugcuguuuucuaggccaaaaauggugagcgaucauuuauuu

SEQ ID NO: 12431 - RNA, 62 nt, Human
cuguuuccccacacuggggggcugggcccugccuccccguuacccuccuucccugcaggccu

SEQ ID NO: 12432 - RNA, 60 nt, Human
aguugcccuuuaaaaaaaaagagcguaaauacaaacaggaguggugcaagccgccuuggu

SEQ ID NO: 12433 - RNA, 62 nt, Human; identical to SEQ ID NO: 9856

SEQ ID NO: 12434 - RNA, 62 nt, Human
uccaggcaacagaacccuuucuucccugucugccccgaccgacccucggacccaguaggaug

SEQ ID NO: 12435 - RNA, 62 nt, Human
ggagggucuggacccuguggcccagccaaaggcuaccagacagccacaaccagcccagccac

SEQ ID NO: 12436 - RNA, 62 nt, Human
auuuacuuagcucaagucugaagcuguagauacuggaagacaaugcaccuuggagggugggc

SEQ ID NO: 12437 - RNA, 62 nt, Human
aaaacaucagccuaauggcucaugucaguaugagcagaaacauuucaaccaugagauaaacc

SEQ ID NO: 12438 - RNA, 62 nt, Human
ugguucucauaucagagucaucauuuuucuuccuguggaauaaaaugccuuguggacuuccc

SEQ ID NO: 12439 - RNA, 62 nt, Human
agggcugugcgaucucuuggccugguccuugcagcuguggcagcagcaggcuccccagcggc

SEQ ID NO: 12440 - RNA, 62 nt, Human
aggaccccccagucguccguucuggucguggggcggggcgcagggaaauacccccagcccug

SEQ ID NO: 12441 - RNA, 62 nt, Human; identical to SEQ ID NO: 9855

SEQ ID NO: 12442 - RNA, 62 nt, Human
agaaggagggggacaaccccccaagaccaucccugaagacgagcaucccccuccucucccug

SEQ ID NO: 12443 - RNA, 62 nt, Human
aguacaauggcagcuacuucgacagaggagccaagggcggcagccgccucugcacaccggaa

SEQ ID NO: 12444 - RNA, 60 nt, Human
cagcugggauccuggaccugggaggccccugugagggccagcucuggaaaaaccugggag

SEQ ID NO: 12445 - RNA, 62 nt, Human
cccggcggcggggaggggaggcgggggcgccuccggcggcgagaugcagaggugacccucgg

SEQ ID NO: 12446 - RNA, 62 nt, Human
uccaccuucagggugucaggccucugggcccaagcuaagccaucauaucuccugugaccugc

SEQ ID NO: 12447 - RNA, 62 nt, Human
ucaugugcaaugagaauuacuuaagaauugguaacgcauguagccuuuuuuaguaaccuugg

SEQ ID NO: 12448 - RNA, 61 nt, Human
uuuguuuuguuuuuucuuuuagaacuguauaguauugaaaaagaaaucaaauguaaauguc

SEQ ID NO: 12449 - RNA, 62 nt, Human
ucagccggguaucaaaagccaugaaacugugucucuguagcaaugagugauacugugacaaa

SEQ ID NO: 12450 - RNA, 61 nt, Human
cuccagagucaaaagggaagucgagggauggggcgucgucagcuggcacugucucugcugc

SEQ ID NO: 12451 - RNA, 62 nt, Human
cugggguauaaucauguuguagguacuuaaaugcauuccgcaaaucaaaauaucuugaugga

SEQ ID NO: 12452 - RNA, 60 nt, Human
guuauguaucacuugcuaaaaauauuguuuuaaucagagauaaccucuuuaaaaaaauuu

SEQ ID NO: 12453 - RNA, 62 nt, Human
caacacauuuuuaaaugacuaacuucuaaaagccccaacacaugacgccaucugaagacccg

SEQ ID NO: 12454 - RNA, 62 nt, Human
gaaggucgagcaggccggggguguccgggaggucuuugggcaucgcggucugggguugggac

SEQ ID NO: 12455 - RNA, 61 nt, Human; identical to SEQ ID NO: 10835

SEQ ID NO: 12456 - RNA, 57 nt, Human
ggaccccagggggauugacucugcaguuugggagccacaaaaagcguagcgguguga

SEQ ID NO: 12457 - RNA, 62 nt, Human
uuucauggcuuuuauucacugugacuaauaagcuuccuaauaaauccuugccagacuuaaug

SEQ ID NO: 12458 - RNA, 62 nt, Human; identical to SEQ ID NO: 11311

SEQ ID NO: 12459 - RNA, 62 nt, Human
ucgccagcuagaagcgggacugaggcugccucacguguugcaagaacaguuuugagccauug

SEQ ID NO: 12460 - RNA, 62 nt, Human; identical to SEQ ID NO: 10334

SEQ ID NO: 12461 - RNA, 62 nt, Human
agacaccuggaucagacuccaagggcugcccugagucugggacuucugccuccauggcuggu

SEQ ID NO: 12462 - RNA, 60 nt, Human
ugguguguggggugggggcagggguagggcgggagagcgaugcuuggauuuuuguuuccu

SEQ ID NO: 12463 - RNA, 62 nt, Human; identical to SEQ ID NO: 9631

SEQ ID NO: 12464 - RNA, 61 nt, Human
uccacaacauccccugggucagacccaccagguaccccguaggaauuuccaguuucccuug

SEQ ID NO: 12465 - RNA, 62 nt, Human
gaguuucacucuuguugcccaggcuggagugaaauggugcgaucucgguucaccgcaaccuc

SEQ ID NO: 12466 - RNA, 61 nt, Human
agcauccuccccacccaccaugguucauuccgacuuuuccaauggaaacucagaucccaaa

SEQ ID NO: 12467 - RNA, 62 nt, Human
cuuccucacccacaggcgugugucacuguggcugggacggcagcgcucagaggagccuccag

SEQ ID NO: 12468 - RNA, 60 nt, Human
guugggguguguggacaucucugggcagcucuugaguccaccuugugccagaucagcagu

SEQ ID NO: 12469 - RNA, 62 nt, Human
cuggguccaguucugaccugagcacgguuuuuccucaugugacuucugggaaggcgcucccu

SEQ ID NO: 12470 - RNA, 55 nt, Human
ccuuaaaauauggaaaauguuuucugaaugcuuuauauucuuucugcuguaaauu

SEQ ID NO: 12471 - RNA, 62 nt, Human
gcaggcucauuccuccuuggucuccugcuuccccucacgcgaauuucuuucaaagccaucug

SEQ ID NO: 12472 - RNA, 60 nt, Human
cagacgagcaccccaugccuauaccucccuccccgagcuaagucccagggcaucugggcc

SEQ ID NO: 12473 - RNA, 62 nt, Human
uaggauucaguaacagugaaguguuuacuaugugcaacgguauugaaguucuuaugaccaca

SEQ ID NO: 12474 - RNA, 62 nt, Human; identical to SEQ ID NO: 10638

SEQ ID NO: 12475 - RNA, 62 nt, Human
cggggcgccugcaugcaggaggaaggaccuguauuagcuggaaaucaucaggaacccagcuu

SEQ ID NO: 12476 - RNA, 62 nt, Human
uuugcucuugcauuagauuugaagauguuuacauuguuguuauuguuauguaucacuugcua

SEQ ID NO: 12477 - RNA, 62 nt, Human
caccccuccugccguugucacacagcucacccacgcggcgcagucacccccaccccgcggau

SEQ ID NO: 12478 - RNA, 62 nt, Human
aacccgacggaucacagugaaagggauuccucccacgccagaucugcacaacgaggcaagac

SEQ ID NO: 12479 - RNA, 62 nt, Human
aaaccgugugauaagguugugugucgugugggaguggggcgauuuuuuaugugccaaauacc

SEQ ID NO: 12480 - RNA, 57 nt, Human
augugccauguacugacccgaaaggcucggccgcagagccggggcccagcgaaucac

SEQ ID NO: 12481 - RNA, 62 nt, Human
gguacucguuggaugucugugaguaccuggucauacgggucaguagggauaagaauugucuc

SEQ ID NO: 12482 - RNA, 60 nt, Human
aggcccaccccuggcuccaccagagccagaagcagagguagaaucaggcgggccccgggc

SEQ ID NO: 12483 - RNA, 62 nt, Human
ccuggcgccugcccuccagggcuggggccucgccuggcgggaccccgcagcagccccggccc

SEQ ID NO: 12484 - RNA, 62 nt, Human
cggaccauucagcggaccgcgggcgcccgguucccaccggcacaaagcgcgccuggccccgc

SEQ ID NO: 12485 - RNA, 62 nt, Human
agaugaauauggaacaucuccuauguaccaggcacugugcuaagugcuggaauacauuaucu

SEQ ID NO: 12486 - RNA, 62 nt, Human
uuguugauaaagcugaggccaguguggaaugugucacuacgauuuuuauuuugagagcauga

SEQ ID NO: 12487 - RNA, 62 nt, Human; identical to SEQ ID NO: 12445

SEQ ID NO: 12488 - RNA, 59 nt, Human
gggaggccugccugcuuuucagguuguuucccauguucagcguggacugcagaaguggc

SEQ ID NO: 12489 - RNA, 62 nt, Human
aggaggaauugaaagaggcuuccucuucucaggaagaagccauuuccuucucauauagggcu

SEQ ID NO: 12490 - RNA, 56 nt, Human
aaagacgacuaauuuccaaacccguuuguucucagauaaaaagcaguuuuauaaac

SEQ ID NO: 12491 - RNA, 62 nt, Human; identical to SEQ ID NO: 9270

SEQ ID NO: 12492 - RNA, 60 nt, Human
agagaaauccaaaguucucuuccaggcacuuggacacuaaaaucuacuaugugggugcaa

SEQ ID NO: 12493 - RNA, 62 nt, Human
ccuguuccuuggugccagcagcuggggcagggaagggugggaggggccccauccaaaggaug

SEQ ID NO: 12494 - RNA, 56 nt, Human
acgggaagccaccugugucagggcuaggcccugggaucgggaguuacacuacccug

SEQ ID NO: 12495 - RNA, 62 nt, Human
guuuguagaggacaggucagcugucuggcucaauggucuacauucugaaguugucugaaaau

SEQ ID NO: 12496 - RNA, 62 nt, Human
uccucccccuucugggagcuccucccccuccccagaaggccaagggaugugggggcuggggg

SEQ ID NO: 12497 - RNA, 62 nt, Human; identical to SEQ ID NO: 12069

SEQ ID NO: 12498 - RNA, 62 nt, Human; identical to SEQ ID NO: 11573

SEQ ID NO: 12499 - RNA, 62 nt, Human
uuuuguaauauuugaauuuuuacauuuguuguacaaucaggaaaagcaauaaagauuuuuca

SEQ ID NO: 12500 - RNA, 62 nt, Human; identical to SEQ ID NO: 12013

SEQ ID NO: 12501 - RNA, 62 nt, Human
aaaaaaaaaaaaaaaaaaaaaaauuagccggccgugguggcaagugccugaaaucccaggua

SEQ ID NO: 12502 - RNA, 62 nt, Human
uuuguaugauguuagcuaauuccacuguguauauaaauuguauuuuuuuuaauuuguaaaau

SEQ ID NO: 12503 - RNA, 62 nt, Human; identical to SEQ ID NO: 9815

SEQ ID NO: 12504 - RNA, 62 nt, Human; identical to SEQ ID NO: 9391

SEQ ID NO: 12505 - RNA, 62 nt, Human; identical to SEQ ID NO: 9815

SEQ ID NO: 12506 - RNA, 62 nt, Human; identical to SEQ ID NO: 9391

SEQ ID NO: 12507 - RNA, 62 nt, Human; identical to SEQ ID NO: 9815

SEQ ID NO: 12508 - RNA, 62 nt, Human; identical to SEQ ID NO: 9391

SEQ ID NO: 12509 - RNA, 62 nt, Human; identical to SEQ ID NO: 10542

SEQ ID NO: 12510 - RNA, 62 nt, Human; identical to SEQ ID NO: 9391

SEQ ID NO: 12511 - RNA, 62 nt, Human
ugguccuuccucacccacaggcgugugucacuguggcugggacggcagcgcucagaggagcc

SEQ ID NO: 12512 - RNA, 58 nt, Human
ugucccccaggccuaggaucagggaccagaggauccuaucuucucagcacccagccca

SEQ ID NO: 12513 - RNA, 62 nt, Human
ggcugccucacguguugcaagaacaguuuugagccauuguuaacaaugccuuuuuucuucac

SEQ ID NO: 12514 - RNA, 59 nt, Human
uauagcaacugcugcgggcgugcacauggcauaggcccaguaacuuacauacaucggcu

SEQ ID NO: 12515 - RNA, 62 nt, Human; identical to SEQ ID NO: 12513

SEQ ID NO: 12516 - RNA, 55 nt, Human
ucucuaggaagcuguuccuuucuaugcccaauagaagcaacaaggcccuagcugg

SEQ ID NO: 12517 - RNA, 62 nt, Human
guuuggccuuaccaaagcaaaagagggugcaagaaugugggaguaugucugccgguuucaac

SEQ ID NO: 12518 - RNA, 56 nt, Human
cccuuaaaauauggaaaauguuuucugaaugcuuuauauucuuucugcuguaaauu

SEQ ID NO: 12519 - RNA, 62 nt, Human; identical to SEQ ID NO: 12517

SEQ ID NO: 12520 - RNA, 56 nt, Human; identical to SEQ ID NO: 12518

SEQ ID NO: 12521 - RNA, 62 nt, Human
uucaggcuuuuaugaggaaagcguuucuguguagaaacuggaagcuguucagggcaucggca

SEQ ID NO: 12522 - RNA, 59 nt, Human
uggccuuaccaaagcaaaagagggugcaagaaugugggaguaugucugccgguuucaac

SEQ ID NO: 12523 - RNA, 62 nt, Human
gcagcaaaaucuagggguguaaguguaucaggacuuaugugacuuauauuuuggggagauga

SEQ ID NO: 12524 - RNA, 55 nt, Human
aggccggggcccagcuccagaaccacccgcccccaccaugcguccugcucucaga

SEQ ID NO: 12525 - RNA, 62 nt, Human; identical to SEQ ID NO: 12523

SEQ ID NO: 12526 - RNA, 55 nt, Human; identical to SEQ ID NO: 12524

SEQ ID NO: 12527 - RNA, 62 nt, Human; identical to SEQ ID NO: 10470

SEQ ID NO: 12528 - RNA, 60 nt, Human
aaagugagaaaauauuugaaagggauuauauuaauugcuaaauauuuuauucacaaaggu

SEQ ID NO: 12529 - RNA, 62 nt, Human; identical to SEQ ID NO: 11351

SEQ ID NO: 12530 - RNA, 61 nt, Human
uauuaugguacaaauaacugauguuuuaaccagaguaaugaccucaguggauuugcuuuaa

SEQ ID NO: 12531 - RNA, 62 nt, Human; identical to SEQ ID NO: 10958

SEQ ID NO: 12532 - RNA, 59 nt, Human
ccagagucaaaagggaagucgagggauggggcgucgucagcuggcacugucucugcugc

SEQ ID NO: 12533 - RNA, 62 nt, Human
ccucccaaucuugcccacacacugagaaguaacucggagcuacagucuguuaaaaaugaaaa

SEQ ID NO: 12534 - RNA, 62 nt, Human
auuucccucacauuaaaagcaaauuuuuaauaucaggcucgaagagcaaaaugauuauuccu

SEQ ID NO: 12535 - RNA, 62 nt, Human
uucaagggaaaugagaaaucgaaggaauuggcccaauggcgaggagaggaaaggccaaggga

SEQ ID NO: 12536 - RNA, 60 nt, Human
uuuuaagucauauauuuucgucccccugaaaaugauggcaagcccaguuucuccugagca

SEQ ID NO: 12537 - RNA, 62 nt, Human
agcccuucuccccgggucugcccuguggggggcuuccggaaaagggaacccugcgguacccc

SEQ ID NO: 12538 - RNA, 60 nt, Human
uacugaguuccagcucucccugcccaucccagccguucgaagcacuagccagccaggaau

SEQ ID NO: 12539 - RNA, 62 nt, Human
uaucaauacuuaggaagaccacagcuagacggacaaacagcauugggaggccuuaguccugc

SEQ ID NO: 12540 - RNA, 62 nt, Human
acucagugcccuccaugcccuggcuggcagaaacccucaacagcagucugggcacugugggg

SEQ ID NO: 12541 - RNA, 62 nt, Human
gucuaguugguagacagguggauguuuggccuccuaagggcacacuucugauccugggcccc

SEQ ID NO: 12542 - RNA, 62 nt, Human
acgugucuugaguaauuuggaacccaaagugaagaucuuugauaaagauuuuuuugugguuc

SEQ ID NO: 12543 - RNA, 62 nt, Human
gccacccccuagccuguggggugcaucugcgaaccagggugaagucacaggucccggggugu

SEQ ID NO: 12544 - RNA, 55 nt, Human
ugcagcccacacagcacaacgucuuaccgugccuauuaccaagcgaguguuugua

SEQ ID NO: 12545 - RNA, 62 nt, Human
agccuucaaggagcccagggguaaguuaacuugucaacggcaugguuuaaucccuucuuuac

SEQ ID NO: 12546 - RNA, 60 nt, Human
aggggguauuuuuaaaaauauuauuuauuuugaaaacgcaucugcuuuucucagcagguu

SEQ ID NO: 12547 - RNA, 62 nt, Human
acucuguuuucauuaauuuguuauuuuucaaaaaccgagccacaccuuuggaaguaaugauu

SEQ ID NO: 12548 - RNA, 62 nt, Human
ccucucccuucccacugcccucugcuucccccagucgucguaauucagccagcugcaguccg

SEQ ID NO: 12549 - RNA, 62 nt, Human
agcuccacaguuaaucuggacagauaccucaauucuaggugaccaacgggagggcuucucaa

SEQ ID NO: 12550 - RNA, 58 nt, Human
aaucccugcauuuccauucagggaaaaggugguagugagcauagaacugcaacaguua

SEQ ID NO: 12551 - RNA, 62 nt, Human
ugggcuguaaaaggcacaggggacucuggccugcggaggccagaaaauguaucgggaauccc

SEQ ID NO: 12552 - RNA, 61 nt, Human
gaggaggaggguggguggguccuuguguggccuggcgcgcaccacagggcagcacgggaga

SEQ ID NO: 12553 - RNA, 62 nt, Human; identical to SEQ ID NO: 9786

SEQ ID NO: 12554 - RNA, 62 nt, Human
ucagggcuacuacgguugaucuugcaacucuguaaauauguauguagacacuuuuaaaagca

SEQ ID NO: 12555 - RNA, 62 nt, Human
ucuuagucuuuacaaauaagcagagcucuuugacauacgcgauuguauguguugagaguuua

SEQ ID NO: 12556 - RNA, 62 nt, Human
ucgcugugggagaagaaugaaauaagacgugaaguguaggaaaucaugaaaagaacaauuuu

SEQ ID NO: 12557 - RNA, 62 nt, Human; identical to SEQ ID NO: 10687

SEQ ID NO: 12558 - RNA, 62 nt, Human
auccuccccacagcgucagugaaagucguccuugucucagaaugaccaggggccagccagug

SEQ ID NO: 12559 - RNA, 62 nt, Human
uucaucuacgauacuucugguucccucccagggacaucgugaggauuaacacuugcuaauau

SEQ ID NO: 12560 - RNA, 60 nt, Human
uuacccaugcuggagugcaguggcacaaucuuggcucagagcaaccucugccucccaggc

SEQ ID NO: 12561 - RNA, 62 nt, Human
cccccacgacaugucucccuuucuuagaauauauuaaagucagagucucugaggaaggaaug

SEQ ID NO: 12562 - RNA, 59 nt, Human
uauugagcuguugcucuuuggcaagcucugugcuaagaacuuuguauacaucaucucau

SEQ ID NO: 12563 - RNA, 62 nt, Human
gcaggggugggcguguuguuugcucaggaaacagggcagccaggcccccaaaacuguguccc

SEQ ID NO: 12564 - RNA, 58 nt, Human
uggaucacgggaaaucaagacacccaggaggaauugaaagaggcuuccucuucucagg

SEQ ID NO: 12565 - RNA, 62 nt, Human
gaaagacucuuaaugcagacucuucuuaaguguuaauagggauuuuuucagcuuauuuuggu

SEQ ID NO: 12566 - RNA, 62 nt, Human
ucauguaauguggucaccauacucaaauggugucauggcugaaguuggccaccuugcuugag

SEQ ID NO: 12567 - RNA, 62 nt, Human
cgaaaucggccagaagccccucucagguuuauucccaaaauaaaccugucucuguugagcca

SEQ ID NO: 12568 - RNA, 62 nt, Human
uacuacuuaggcccaaggagcaagggguagaauggcaucuaaccagagcaaagccauuucuu

SEQ ID NO: 12569 - RNA, 62 nt, Human
ggagagccuagaccaggcuccgggcugccaauaaagaagugaaaugcguaucuggucuccug

SEQ ID NO: 12570 - RNA, 60 nt, Human
caccaggcccaacccugugcuggucaagccagggcagucacagcugcuuggggcccacag

SEQ ID NO: 12571 - RNA, 62 nt, Human
ggccaguugucugguuuccauguauucuaggccagguaggcaacacagagccaaggcgggug

SEQ ID NO: 12572 - RNA, 60 nt, Human
ccaucacagcucaucugcccgcggcugcgugaggacagcagggguuuuucuucagagucu

SEQ ID NO: 12573 - RNA, 62 nt, Human
cuuauuuuauuuccuccuuaacaguauuuuuggcauuagacauucuuauugugaagaaauaa

SEQ ID NO: 12574 - RNA, 60 nt, Human
cugcccccuggcccccacucccccggcuccguguaaaauaaauguuccagcccaaccugu

SEQ ID NO: 12575 - RNA, 62 nt, Human
accuacugagcuauauucacugugcuguccuagggggagggagagcagagcucgccccugca

SEQ ID NO: 12576 - RNA, 60 nt, Human
aaagagcugaaggguuacgcccugcugccaacgugcuuaaaaaaagaccguuucugacuc

SEQ ID NO: 12577 - RNA, 62 nt, Human
cugggccauccaggcggcucugcucccaccagacaggagcuaggccucacuggcaggggggc

SEQ ID NO: 12578 - RNA, 56 nt, Human
gucuuuuaccaaaagugucuguacagcagccauccaaguugccccuacuuaguggc

SEQ ID NO: 12579 - RNA, 62 nt, Human; identical to SEQ ID NO: 10756

SEQ ID NO: 12580 - RNA, 62 nt, Human
cagagaaaucuuacagaaaacaggggugggaaucucuuccgauagagucgcuauuucugguu

SEQ ID NO: 12581 - RNA, 62 nt, Human
agcacaccccuuagcgcuugccuagguugcugaaaacagggaggcaccugguaucucgagug

SEQ ID NO: 12582 - RNA, 59 nt, Human
aacugcugucuaggaccaccugcccuaaccaggaauaaaggcaagacagccuggagacc

SEQ ID NO: 12583 - RNA, 62 nt, Human
agcuugagaacagaagggcgucgggggaaccugccgcaaggagcagagacagcacagccccc

SEQ ID NO: 12584 - RNA, 60 nt, Human
cccucagccgcggagccucugcggaggcugagccccgcgaccggagcgccgcucuccgcu

SEQ ID NO: 12585 - RNA, 62 nt, Human; identical to SEQ ID NO: 10202

SEQ ID NO: 12586 - RNA, 56 nt, Human
agguuuuaacaaaaggaugaggccagaacucuuccagaaccaucaccuuugggaac

SEQ ID NO: 12587 - RNA, 62 nt, Human
agggagauuucgguuuugagguuucuaaauacauuaaaguuauuucuuaagaaccuggauuu

SEQ ID NO: 12588 - RNA, 60 nt, Human
cggggcuccggccuccugccaaggcucuuguccccauacaccaucccacaagggcgcugg

SEQ ID NO: 12589 - RNA, 62 nt, Human
ucgugcuggaggaacuugcugcugugccugcgucgcggcggauccgcggggacccugccgag

SEQ ID NO: 12590 - RNA, 61 nt, Human
gcuggucaagccagggcagucacagcugcuuggggcccacagcacugcugccuggucucca

SEQ ID NO: 12591 - RNA, 62 nt, Human
gcaugugguuuuaaaaauagacaguauuuuuuaaaaaucaaaaaaugacuugcaaauuguuu

SEQ ID NO: 12592 - RNA, 60 nt, Human
aagauccaguuaaaucacccacugaggugacagcucauuagcggggagagagauggagca

SEQ ID NO: 12593 - RNA, 62 nt, Human
cuggcuucugccacagcgcaccugucugccgcugccgccucagcugcuuuggcccagccagc

SEQ ID NO: 12594 - RNA, 62 nt, Human
aggaggcugaggcaggagaaucacuugagcccgggaaguggagguugcacugagcugagacc

SEQ ID NO: 12595 - RNA, 62 nt, Human; identical to SEQ ID NO: 10063

SEQ ID NO: 12596 - RNA, 61 nt, Human
ccucggcgucacgcaaugcucaccucgccucuuccccacuaacaucccagacuuuaaaauu

SEQ ID NO: 12597 - RNA, 62 nt, Human
gcacauccuucacauuggcugcuuuguucuggaauauggauaucucagccuggaugccgagg

SEQ ID NO: 12598 - RNA, 62 nt, Human
augauuagcuggcucuguuuuuugguuaaauaagagucuuuaauccuuucuccaucaagagu

SEQ ID NO: 12599 - RNA, 62 nt, Human
uuucacuauaagaguacuuuauuuuaaauguucuuuaggagaacauuuugcuaaagcaugac

SEQ ID NO: 12600 - RNA, 62 nt, Human
uagguuuuugucuuuacaaauuauuuucagaaauggcuaaaaguguacagaaaacaguaaau

SEQ ID NO: 12601 - RNA, 62 nt, Human
ggcauuuuguggcugcagaggaaauggguuggcucugaacaaagaugcaguuucuagggccg

SEQ ID NO: 12602 - RNA, 60 nt, Human; identical to SEQ ID NO: 9707

SEQ ID NO: 12603 - RNA, 62 nt, Human
gagaucaccgcaaaccuaccuuacuguguugaaacgggacaaaugcaauagaacgcauuggg

SEQ ID NO: 12604 - RNA, 62 nt, Human
ugggagucguggcgggggucucucgccaccccuuuccggagagccuccccucccuccagacc

SEQ ID NO: 12605 - RNA, 62 nt, Human
guccugcuagccuuccuccaggaagcacacugggugcagauaaucaggacauuccagagauc

SEQ ID NO: 12606 - RNA, 62 nt, Human
ggcgcccggcggcagcugcccagaaacuuccugggagaaagagcccucgggcugccuucccc

SEQ ID NO: 12607 - RNA, 62 nt, Human
uuugagcuugugaaagauuucugaacagugauugucccguuaauagccccucagaagauguu

SEQ ID NO: 12608 - RNA, 62 nt, Human
acugcuugggccuugcugagccaggguccucagggugaagcaggacugaggaguggccagcu

SEQ ID NO: 12609 - RNA, 62 nt, Human
cccuuccuccgggugaccccacagggccuuuccaagcccccauuugagcugcuccuuccugu

SEQ ID NO: 12610 - RNA, 59 nt, Human
uugguuuuuuuuuuuuuuuuuuuaacuugggaccaccaaguuguaaagauguauguuuu

SEQ ID NO: 12611 - RNA, 62 nt, Human; identical to SEQ ID NO: 9270

SEQ ID NO: 12612 - RNA, 62 nt, Human; identical to SEQ ID NO: 10062

SEQ ID NO: 12613 - RNA, 62 nt, Human; identical to SEQ ID NO: 12511

SEQ ID NO: 12614 - RNA, 62 nt, Human
cccuaccugcugcaucgucaggcucccacgcuuuguccgugaugccccccuacccccucacu

SEQ ID NO: 12615 - RNA, 62 nt, Human
cgccuggaaucucagcgaggccaaggagaguggaucaccugaggucgggaguuccagaccag

SEQ ID NO: 12616 - RNA, 61 nt, Human
uagugucucuuuaguaaaauaccaaacaugucuuuguaucaaggaacuuaaaauuucucaa

SEQ ID NO: 12617 - RNA, 62 nt, Human; identical to SEQ ID NO: 12169

SEQ ID NO: 12618 - RNA, 62 nt, Human
aagaggcccacccucucgguccggaacaagacgccucggccacggcucccccucggccuauu

SEQ ID NO: 12619 - RNA, 62 nt, Human
ccaugcagucauguucacgugcuaguuacguuuuucuucuuacacaugaaaauaaaugcaua

SEQ ID NO: 12620 - RNA, 57 nt, Human
cgcggaagggaauggauagacuggugugcucaaaagagagagaucacucaaaugauu

SEQ ID NO: 12621 - RNA, 62 nt, Human
ggagcacuucccaggggccgcagggacgacacucuccagggaggccccagcaaccacaccau

SEQ ID NO: 12622 - RNA, 62 nt, Human
caggccccugcuguucucagccucaguuugccaucuaugaaaugagguggaccccucuccau

SEQ ID NO: 12623 - RNA, 62 nt, Human
acuguggcucacgccuguaaucccagcacuuugggagaccgaggcagguggaucacgagguc

SEQ ID NO: 12624 - RNA, 61 nt, Human
cccaccugcccgaaaaccacugaagccacccuccgcccggacucaacagccgccagcaagc

SEQ ID NO: 12625 - RNA, 62 nt, Human; identical to SEQ ID NO: 9945

SEQ ID NO: 12626 - RNA, 60 nt, Human
aguguguguguacugcagcuggagugggccccagaccagagaaaagugguaaagaaucua

SEQ ID NO: 12627 - RNA, 62 nt, Human; identical to SEQ ID NO: 9588

SEQ ID NO: 12628 - RNA, 62 nt, Human
gccagcuggcgugucgggaaggauccaggaucugcaaacacaacugcucaggccuucucacg

SEQ ID NO: 12629 - RNA, 62 nt, Human
caagagaagacuuucagccucuugaucaccagcacgaccauacuguuucagaaagcugggug

SEQ ID NO: 12630 - RNA, 61 nt, Human
cuuccccccaggaaacacauguucauuugugugaucauguauagaccucagaacggaagau

SEQ ID NO: 12631 - RNA, 62 nt, Human
cuaauuaacuuuuggcagguacaacagauaaguccucacaaacuguucccagcccuaggcug

SEQ ID NO: 12632 - RNA, 60 nt, Human
cucuaggcuuuuuuccuuuugggguucuacagucguaaaagagauaauaagauuaguugg

SEQ ID NO: 12633 - RNA, 62 nt, Human; identical to SEQ ID NO: 9641

SEQ ID NO: 12634 - RNA, 62 nt, Human
ccacuucuuuuuaggagcaaaucuccccagggguguacgguauuucuugacucugggaacag

SEQ ID NO: 12635 - RNA, 62 nt, Human
ccucugucgccccugugagcugagcugguuaggaaccacagacugugacagagaagguggcg

SEQ ID NO: 12636 - RNA, 62 nt, Human
agaggcuuccucuucucaggaagaagccauuuccuucucauauagggcuguauucaaacauc

SEQ ID NO: 12637 - RNA, 62 nt, Human; identical to SEQ ID NO: 12153

SEQ ID NO: 12638 - RNA, 60 nt, Human
ggucacugcuggcccuagcauuggacccuaggagaccugacuggaacuggcucccucccc

SEQ ID NO: 12639 - RNA, 62 nt, Human
cacgcgggguccggccugggauccaggcuaagggccggcggaagaggccccaauggggcggu

SEQ ID NO: 12640 - RNA, 62 nt, Human
cccggcgccugccggcgggcuccgcucuugggacaccggagaaccuaucaugucagccagcg

SEQ ID NO: 12641 - RNA, 62 nt, Human
guccugucuucucuuggcgcucuuuccuuccaccuuucccaagaguccugguugcacguuuu

SEQ ID NO: 12642 - RNA, 55 nt, Human
auguucauuauggugcugggaagcucugucuuugauuuaaaauaaaauagcuaaa

SEQ ID NO: 12643 - RNA, 62 nt, Human
uucuguuuugaagcaugggccagacccggcacugcgcucggagagccggugggccuggccuc

SEQ ID NO: 12644 - RNA, 55 nt, Human
guggggcgaugcugcagcggcugaaaccacgucaagucccccagagcccggcauu

SEQ ID NO: 12645 - RNA, 62 nt, Human
gguggcuaaugaagugaggggagggagggaugucaccccaaaaguaggcccucccauuggcu

SEQ ID NO: 12646 - RNA, 62 nt, Human; identical to SEQ ID NO: 9285

SEQ ID NO: 12647 - RNA, 62 nt, Human; identical to SEQ ID NO: 9298

SEQ ID NO: 12648 - RNA, 62 nt, Human; identical to SEQ ID NO: 9299

SEQ ID NO: 12649 - RNA, 62 nt, Human
uggugcugcuaccuuguauguuuacauaaugcuuuagcccaaggacacaucaccaacccaug

SEQ ID NO: 12650 - RNA, 58 nt, Human
gggaaucggguacuuugcuuguugaauaaugcacuuuaaaacaaggaaccguaucagg

SEQ ID NO: 12651 - RNA, 62 nt, Human
guccugggagaggacagggacuucgcagaggcaagcgaccgaggcccucccaaagaggcccg

SEQ ID NO: 12652 - RNA, 62 nt, Human; identical to SEQ ID NO: 10722

SEQ ID NO: 12653 - RNA, 62 nt, Human; identical to SEQ ID NO: 9652

SEQ ID NO: 12654 - RNA, 61 nt, Human
uccuggccguccacagggucggcccucagcucagcccgccaggagucagggaggagacucg

SEQ ID NO: 12655 - RNA, 62 nt, Human
ucaucggaaaaacuuuucuuguaugcaugagacucaacaucaggauccacagcuuaaagaug

SEQ ID NO: 12656 - RNA, 62 nt, Human
ggccgugagucccguggcagagccuucugggcgcugcgggaacaggagauccucugucgccc

SEQ ID NO: 12657 - RNA, 62 nt, Human
gucaacaaaauugagccauuuuuuuaaaguaauagauacuaauagauuaucuuuucugaugc

SEQ ID NO: 12658 - RNA, 62 nt, Human
uuugccugauugguaaaccaacacacuacaauugauaucaaaagguuucuccuguaauauuu

SEQ ID NO: 12659 - RNA, 62 nt, Human; identical to SEQ ID NO: 11619

SEQ ID NO: 12660 - RNA, 62 nt, Human; identical to SEQ ID NO: 11751

SEQ ID NO: 12661 - RNA, 62 nt, Human; identical to SEQ ID NO: 11619

SEQ ID NO: 12662 - RNA, 62 nt, Human; identical to SEQ ID NO: 11751

SEQ ID NO: 12663 - RNA, 62 nt, Human; identical to SEQ ID NO: 9713

SEQ ID NO: 12664 - RNA, 62 nt, Human
ucccagaguuuucuuuggagaacagaaagaagaaaggaaagaaaggaaccagaggcagagag

SEQ ID NO: 12665 - RNA, 62 nt, Human
ugcuggaugcuuaauggugcuagaggcucaaguguguuugaaaccaagagccaguugucccc

SEQ ID NO: 12666 - RNA, 62 nt, Human
cugaguggguggcagagacuccugcgaugcccgucucagguagcuguggggcaccagcccac

SEQ ID NO: 12667 - RNA, 62 nt, Human
aacaagccaacgacaaagccaaacucugccagccacauccaaccccccaccugccauuugca

SEQ ID NO: 12668 - RNA, 58 nt, Human
guaggaagaacagugacaucauuacaaaaucaucaauagcagcaauagcugguguuua

SEQ ID NO: 12669 - RNA, 62 nt, Human
aaaaaaauuagccggccgugguggcaagugccugaaaucccagguacucaggaggcugaggc

SEQ ID NO: 12670 - RNA, 61 nt, Human
uuuuuauauuaaugacuauugaaagugguaauaaaaauuuauauuauaggcuucaauguuu

SEQ ID NO: 12671 - RNA, 62 nt, Human; identical to SEQ ID NO: 12105

SEQ ID NO: 12672 - RNA, 62 nt, Human
guccagccccugcuucacccgcagaugcagaccccgucguuaucugagggucccagggagcu

SEQ ID NO: 12673 - RNA, 62 nt, Human
aucgcauggauuucuuuuucagugacguucaaguguuucucacggauggaauucuagucagc

SEQ ID NO: 12674 - RNA, 61 nt, Human
uuugcuuuacucuuucuuuaugauugcaucugaccgcaccaaggugggccaugcguuguuu

SEQ ID NO: 12675 - RNA, 62 nt, Human
cugacuuuauucauauuuccccagaaauuaaugucguucggaucaagauaaagcuuaaaauu

SEQ ID NO: 12676 - RNA, 59 nt, Human
ucgggcuccagggugcugcugcgggggucccggcgcugagccgggccccggggccgcgg

SEQ ID NO: 12677 - RNA, 62 nt, Human
acaaaaaaagaaugcuguuccugcaccugccgguuauuuccaagaagcugaaucuuugggac

SEQ ID NO: 12678 - RNA, 56 nt, Human
aaagcguuaccucucauuucucuuugugauucuugacggugacucuuguauguaau

SEQ ID NO: 12679 - RNA, 62 nt, Human
cagggcgguagcagcaaagcguggcaucgccucgguuucuuacaaaaauucauaauaauauu

SEQ ID NO: 12680 - RNA, 57 nt, Human
uguuuuuuuaauugguguuagaugacaugauuaauaaaaaaggcaagauauuuucag

SEQ ID NO: 12681 - RNA, 62 nt, Human
uugugggggagggcaaggcucuccucccagccagggacgccaggacauagcugcuccugguc

SEQ ID NO: 12682 - RNA, 62 nt, Human; identical to SEQ ID NO: 11748

SEQ ID NO: 12683 - RNA, 62 nt, Human; identical to SEQ ID NO: 12440

SEQ ID NO: 12684 - RNA, 62 nt, Human
gaaccacagacugugacagagaagguggcgaccagcccagaagaggcccacccucucggucc

SEQ ID NO: 12685 - RNA, 62 nt, Human
agggccgaucuggguguccugacccucagcuggcccugcccagccacccuggacgugaccgu

SEQ ID NO: 12686 - RNA, 60 nt, Human
auaauggagaaauuuucuaucucugucccuauuuguauaagccaaggugaugcugggugc

SEQ ID NO: 12687 - RNA, 62 nt, Human
uccaaaguuauuuuaaucuauacaauuaaaaacuuuugccuaucacucuggacuguuggauu

SEQ ID NO: 12688 - RNA, 60 nt, Human
ccagcaacaccugcaguccagccccccucuucuaggaugagccacuguagaucauuaaag

SEQ ID NO: 12689 - RNA, 62 nt, Human; identical to SEQ ID NO: 12687

SEQ ID NO: 12690 - RNA, 60 nt, Human; identical to SEQ ID NO: 12688

SEQ ID NO: 12691 - RNA, 62 nt, Human
ucauggucacauuuaacaguuuugacauguuauacuugcgcauagauccaagcguuucuugg

SEQ ID NO: 12692 - RNA, 61 nt, Human
uuugcaauugauacugaaguacuuugccauggaguuaguaacuccugagcagaccauuuua

SEQ ID NO: 12693 - RNA, 62 nt, Human
gcccacuuguggcugcagcuuuaugccaaauuauauugcagacugaacagacguuuaucuau

SEQ ID NO: 12694 - RNA, 60 nt, Human
cuuccugcggguucuuggcgagacacagcuugagaacagaagggcgucgggggaaccugc

SEQ ID NO: 12695 - RNA, 62 nt, Human
gcacaacgucagccagaacaucgcggccgagacccgggcugaggacccgccgugguuugaag

SEQ ID NO: 12696 - RNA, 62 nt, Human; identical to SEQ ID NO: 9334

SEQ ID NO: 12697 - RNA, 62 nt, Human
agaaucuuacuucucuuuguuccugauauauuaaaauggccaguuaggcucuuuuuguaguu

SEQ ID NO: 12698 - RNA, 62 nt, Human
acacgauuguuccacugucuggaagcaccauccccuaucgcaggacuccugggccacaagca

SEQ ID NO: 12699 - RNA, 62 nt, Human
uggggccacccacguccuugcacacgacuuugggaaacgcgagaaaguaaacucugccuagc

SEQ ID NO: 12700 - RNA, 55 nt, Human
ugcgugccuggcccuaugagggcggcggcgggacagggugagcggagagacagaa

SEQ ID NO: 12701 - RNA, 62 nt, Human
ggucccagccuuugcaggagggguugaggacgcagcacccgauugagccguggucaccgaga

SEQ ID NO: 12702 - RNA, 62 nt, Human
ugccucggccaccccacgcgggaacccagcgccguccucugaaggcagggccuuggccacgu

SEQ ID NO: 12703 - RNA, 62 nt, Human
cgggguuucaccauguuggucaggcuggucucaaacuccugaccucaggugauccgcccacc

SEQ ID NO: 12704 - RNA, 61 nt, Human
aagcaugacuaaacugcaaaaaaaaaaaaagagcuacuguauuuagacuuaggaaaaaagg

SEQ ID NO: 12705 - RNA, 62 nt, Human
uccgcagccacuccugggccuuuuaugugccgaguuaccccacuugccuugggcguguccac

SEQ ID NO: 12706 - RNA, 60 nt, Human; identical to SEQ ID NO: 10289

SEQ ID NO: 12707 - RNA, 62 nt, Human
ugguccaaauucagauuaagccccugagcuuguucggacguagccaccagaucgaauuucga

SEQ ID NO: 12708 - RNA, 62 nt, Human
cuaaauaccugauuuaaaaauagaagacauccccaguccucaugacauaccgcaaauaucug

SEQ ID NO: 12709 - RNA, 62 nt, Human
ucauucauucauacagcaaauauuacugguacaucuuccacaugccaggcccugcaaagugc

SEQ ID NO: 12710 - RNA, 58 nt, Human
agagaaaaaaaaaauuaaaggcuuugaauccuuuacgaaaguguacaccacugugccu

SEQ ID NO: 12711 - RNA, 62 nt, Human
caugccuaugggugacugccuucucccagaguuuucuuuggagaacagaaagaagaaaggaa

SEQ ID NO: 12712 - RNA, 62 nt, Human
ggcaggcaccgggcaugucggcgccucuggucaaaccaccuacacugccuggggugggucuc

SEQ ID NO: 12713 - RNA, 62 nt, Human
ccugggauuugcuauugaaucucuacccucucccaccacacaguacugauugcucacugaaa

SEQ ID NO: 12714 - RNA, 58 nt, Human
uauauuugaacagcuaguaguuagcuuugaaaguggaagugugaacagacacuacuug

SEQ ID NO: 12715 - RNA, 62 nt, Human
ccucuggugcuugguugaacaagggaaucacaagaaaacgaaaaugcaaaaacugaacuucg

SEQ ID NO: 12716 - RNA, 60 nt, Human
cuguagccucaaguaagaccaccugugaacuugaucauuaucuggcccaaauaugaagau

SEQ ID NO: 12717 - RNA, 62 nt, Human
agcauggacgugugcauguuaugagcgugugcuuauccguuaaggcuggaggcacauguggg

SEQ ID NO: 12718 - RNA, 62 nt, Human; identical to SEQ ID NO: 9233

SEQ ID NO: 12719 - RNA, 62 nt, Human; identical to SEQ ID NO: 12593

SEQ ID NO: 12720 - RNA, 62 nt, Human
guauagaauggugggaauucaaauuuuucuaaacucaugguaaguauauuguaaaauacaua

SEQ ID NO: 12721 - RNA, 62 nt, Human; identical to SEQ ID NO: 12593

SEQ ID NO: 12722 - RNA, 62 nt, Human; identical to SEQ ID NO: 12720

SEQ ID NO: 12723 - RNA, 62 nt, Human
agguucuuuacaagaugauaccuuaauuacacucccgcaacacagccauuauuuuauugucu

SEQ ID NO: 12724 - RNA, 58 nt, Human
ucuuccuucccuccucugucccugccucggccaccccacgcgggaacccagcgccguc

SEQ ID NO: 12725 - RNA, 62 nt, Human
ccggaaaauugugcucuagaagaauaaaacugaaaaacucuagagaauuuuuuuuccccauu

SEQ ID NO: 12726 - RNA, 62 nt, Human
cagcuguggacuccagcauguuucugauaauuaugcaagcaacaauucuguagccucaagua

SEQ ID NO: 12727 - RNA, 62 nt, Human
cagccuguuaaugaacagccauacguguaagcuuuuucuugaguguuaagucuuuuaccaaa

SEQ ID NO: 12728 - RNA, 62 nt, Human; identical to SEQ ID NO: 11651

SEQ ID NO: 12729 - RNA, 62 nt, Human
aaaauuacauuuuuuuuccaggggagaaaaaaacaucaaacaaaaacaucuaaaucauccuu

SEQ ID NO: 12730 - RNA, 59 nt, Human
gguggagguugcuagucuaguuuccuuuuugagauacuauuuucauuuuugugagccuc

SEQ ID NO: 12731 - RNA, 62 nt, Human
caccgcccaccagaaacauaaaggauuaaaaucacacuaauaaccccuggauggucaaucug

SEQ ID NO: 12732 - RNA, 60 nt, Human
auaguuaauacagguauaucuauuuuuauuuacuuuguaagaaacaagcucaaggagcuu

SEQ ID NO: 12733 - RNA, 62 nt, Human
ugccugaauacauaucacguauuuuagacucgaagccucaaagcacuggauugugguccccu

SEQ ID NO: 12734 - RNA, 62 nt, Human; identical to SEQ ID NO: 10623

SEQ ID NO: 12735 - RNA, 62 nt, Human; identical to SEQ ID NO: 10932

SEQ ID NO: 12736 - RNA, 57 nt, Human
gccugaaaucccagguacucaggaggcugaggcaggagaaucacuugagcccgggaa

SEQ ID NO: 12737 - RNA, 62 nt, Human
gcuggaaaaaccugaaacgucaacucugcuucaaggucggcaagaagaacagaaggcggaga

SEQ ID NO: 12738 - RNA, 62 nt, Human
gccugggagaccaccccuugccacuugggccacuuccgccuaccccacuuuucauuuuguuc

SEQ ID NO: 12739 - RNA, 62 nt, Human; identical to SEQ ID NO: 9690

SEQ ID NO: 12740 - RNA, 62 nt, Human
acucuauggcggauuuuuuuuuuaacuuucuucuuccuguuaaaacauaggucacuaacugu

SEQ ID NO: 12741 - RNA, 62 nt, Human
gcagggcugguuagccccucccacugccugacaccugggacaggcugggcagaggggagaga

SEQ ID NO: 12742 - RNA, 60 nt, Human
gcagucugcaucuuuucuucccuuggugugggagagguaaacacuuugauuugcugaaag

SEQ ID NO: 12743 - RNA, 62 nt, Human; identical to SEQ ID NO: 12741

SEQ ID NO: 12744 - RNA, 60 nt, Human; identical to SEQ ID NO: 12742

SEQ ID NO: 12745 - RNA, 62 nt, Human; identical to SEQ ID NO: 12741

SEQ ID NO: 12746 - RNA, 62 nt, Human
gcugcuguuauucaaaaggccauuuaugaaguuaguauuugagccccauaagaucuuuaaaa

SEQ ID NO: 12747 - RNA, 62 nt, Human
gaacccugcuccguuggucagcguuacuaucaucucggaucauauggagcucaugucagccg

SEQ ID NO: 12748 - RNA, 60 nt, Human
cuggggccgccgcacccugcaccuuggaccggcauccguagccauggacagaggucccug

SEQ ID NO: 12749 - RNA, 62 nt, Human
augcuccauuuuuaaaguuuuauaacuuguguuauuuaaugagucagucaaucggcugcagu

SEQ ID NO: 12750 - RNA, 62 nt, Human
uggucacauuugacaguuuugcuaaaauccaaaguaagcucauaaaaauaauugaugauaac

SEQ ID NO: 12751 - RNA, 62 nt, Human
aaauuuacaacugcagaugacguaugugccuugaacugaauauuuggcuuuaagaaugauuc

SEQ ID NO: 12752 - RNA, 60 nt, Human
ucugccugggaacccgcacugugccuggguguauucuuuauacuguagauaauggagaaa

SEQ ID NO: 12753 - RNA, 62 nt, Human
accacaugggugcaagucagcauuguaaguuuucucagguuauuauuauuagagagguugga

SEQ ID NO: 12754 - RNA, 62 nt, Human
guacucaggaggcugaggcaggagaaucacuugagcccgggaaguggagguugcacugagcu

SEQ ID NO: 12755 - RNA, 62 nt, Human
cuagaagucggagcagaggaugguacagcagaggccgaaccagaagccggagcaguuccuac

SEQ ID NO: 12756 - RNA, 58 nt, Human
uaucuaaagugggagaagauacauacacaguauggcaaauggauaaaauauuguggca

SEQ ID NO: 12757 - RNA, 62 nt, Human
agccaccgugccuggucuguuuuuuuuuuuuuuuuggcaauagagucuugcucgcccagggu

SEQ ID NO: 12758 - RNA, 61 nt, Human
agucuuaagaaaagaccuccagcaguuacacauucauaucaaccagcacaacacgggaugg

SEQ ID NO: 12759 - RNA, 62 nt, Human
uucguguuuuauaaauagcucucauagucugcuccaucuugauaguuaagugauuucugaag

SEQ ID NO: 12760 - RNA, 62 nt, Human; identical to SEQ ID NO: 12521

SEQ ID NO: 12761 - RNA, 62 nt, Human
uuaaaggguugacccacacuagacgaaacuggacucguacgacucuuuuuauauuuuuuaua

SEQ ID NO: 12762 - RNA, 61 nt, Human
agugaaaacacgagugugaaccucucuccccugcgucgccaccucuguaauugauguacau

SEQ ID NO: 12763 - RNA, 62 nt, Human; identical to SEQ ID NO: 9994

SEQ ID NO: 12764 - RNA, 62 nt, Human
ggguguuauuuuuccccacugaaugccacaccauugaaaauagacugcucauccccucuucc

SEQ ID NO: 12765 - RNA, 62 nt, Human
gaauuccacugccagugacccacugccuccggccguacacgacagugccuugacccaacagc

SEQ ID NO: 12766 - RNA, 60 nt, Human
agcaacuaugucucccuaggauggccccacaggcgacggaaugccugcgcugggacccga

SEQ ID NO: 12767 - RNA, 62 nt, Human
ccaucaccuuugggaaccugcugugagagugcugagguaccagaagugugagaacgaggggg

SEQ ID NO: 12768 - RNA, 57 nt, Human
gggagugcccugugugauggaggcgauacagccccuaccuucagagagcaccuggcc

SEQ ID NO: 12769 - RNA, 62 nt, Human
agaaaaggggcagggcucugcagccgccaggacagacgagcaccccaugccuauaccucccu

SEQ ID NO: 12770 - RNA, 61 nt, Human
cucgaugcacugaccugcuccgccaggaaagugagcguguagcguccugaggaauaaaaug

SEQ ID NO: 12771 - RNA, 62 nt, Human
ccuuguuugccccucagcgugccaggcagacugggggcaggacagccggaagcugagaccaa

SEQ ID NO: 12772 - RNA, 60 nt, Human
ccccgugucugcccaggugggcagccuugagcccaggggacucagugcccuccaugcccu

SEQ ID NO: 12773 - RNA, 62 nt, Human
uugaguguuugggauuucaagcucgcucucuuucucucacuauuaggacuuuucuuuuucuu

SEQ ID NO: 12774 - RNA, 62 nt, Human; identical to SEQ ID NO: 9249

SEQ ID NO: 12775 - RNA, 62 nt, Human
ccacuuuguuuguaaguaugaucugggccucaaaauaccauaguagcugcuugauaaaauuc

SEQ ID NO: 12776 - RNA, 62 nt, Human
ugguggugguacaguuggaauuagugccaugucauacacaaauguuccacaaggcgggagug

SEQ ID NO: 12777 - RNA, 62 nt, Human
gcuguggugccgggcuccagacacuucacggaaggaagaucacauguccccagagaggcacc

SEQ ID NO: 12778 - RNA, 62 nt, Human
uccaccccaagucauacacuggacccagugccugcggggacaggacuguggguuucuugguc

SEQ ID NO: 12779 - RNA, 62 nt, Human
cccacugggccugguguguauggcauagggaccagucuacuaugacccugagccuguggaaa

SEQ ID NO: 12780 - RNA, 59 nt, Human
auuuauuucuuguauuguuuggaagaaaaaaugaugauagagucccaaaaagaagagaa

SEQ ID NO: 12781 - RNA, 62 nt, Human
caguuccuuugaucucgcuguaagauuugucaaggcugacuacucacuucuccuuuaaauuc

SEQ ID NO: 12782 - RNA, 62 nt, Human; identical to SEQ ID NO: 11453

SEQ ID NO: 12783 - RNA, 62 nt, Human; identical to SEQ ID NO: 10847

SEQ ID NO: 12784 - RNA, 60 nt, Human
uaggaggcaccgagcccagcgcagcagccucggacccggauugcguuugccuuagcggau

SEQ ID NO: 12785 - RNA, 62 nt, Human
uuauuucuuucgguuucggaugcaaaacaaaaaauuuuaaaagaaaaugugacuucaaagga

SEQ ID NO: 12786 - RNA, 62 nt, Human
acaaccaagaacaaagccccgggacuguuuucuuuuuaauaaagccacaggcaggcaucgua

SEQ ID NO: 12787 - RNA, 62 nt, Human
augugagaaugccuucauuuaaaaacuuuaugaagguaucgauaacauaacucauucuagag

SEQ ID NO: 12788 - RNA, 62 nt, Human
agacuauaacauuuguuguaauaauugcuagguugaaguucaacauguaaaaaaagggggca

SEQ ID NO: 12789 - RNA, 62 nt, Human
aaaagaaaaugugacuucaaaggaaaggaacaaauuuucaaagacuugggggagugaaggca

SEQ ID NO: 12790 - RNA, 58 nt, Human
ucuacuuaaacauaaugucugugucaucaaguauuauagucagacuuuucuuuuuuuc

SEQ ID NO: 12791 - RNA, 62 nt, Human
gggcaggucagaguggagcagugcuaagaggcuguugcaggagaacuagacgggcggggccu

SEQ ID NO: 12792 - RNA, 59 nt, Human
ggaagcucacuguggacagucuucuuuccuucugacagaccaggucaucuggcuuccga

SEQ ID NO: 12793 - RNA, 62 nt, Human
ugccagcugcagagcauauuguggauuggaaaggcugcgacagccccccaaacaggaaagac

SEQ ID NO: 12794 - RNA, 61 nt, Human
ggggaccaaugauuccauccgcauggaagcccacgugugcacuuaggggcccauaaauggc

SEQ ID NO: 12795 - RNA, 62 nt, Human
gggauggcaagggcuuucagacgcauuuccaagaguccagcaagccagggggaagaugaucc

SEQ ID NO: 12796 - RNA, 62 nt, Human
ccggcaugccccgaucuuucacacacuggugacccugagagaggagggaggagggaaccugg

SEQ ID NO: 12797 - RNA, 62 nt, Human
cugugucuuugcuguucuucagacuccauuuauagagaaugagggcugauaacaggaauaca

SEQ ID NO: 12798 - RNA, 61 nt, Human
cuugcccgacagaaccauccccacugugaggcugugagagauuuguggcaggaacuguuua

SEQ ID NO: 12799 - RNA, 62 nt, Human
agaauaucucugccuucuuaccuuaaauuaaaaagagcacuaagauaacaccuucaagagac

SEQ ID NO: 12800 - RNA, 60 nt, Human
uccgggugaccccacagggccuuuccaagcccccauuugagcugcuccuuccugugugug

SEQ ID NO: 12801 - RNA, 62 nt, Human
agagagagagcgggaggagggucuggcuuggggaccagacgaggugcagggaggguaggagc

SEQ ID NO: 12802 - RNA, 61 nt, Human; identical to SEQ ID NO: 10938

SEQ ID NO: 12803 - RNA, 62 nt, Human
cgaugauaaaaacaucuaccugacucuuccucccaacgaccaugucaacaguaauaacuaaa

SEQ ID NO: 12804 - RNA, 59 nt, Human
caggggcagggugauaaauuguugauaaauuccacuggacuugagcuuggcagcugaac

SEQ ID NO: 12805 - RNA, 62 nt, Human
ggugauguacccaugcuccgugugucugugucugcauguccacacgucugaugcaccugugu

SEQ ID NO: 12806 - RNA, 62 nt, Human
ccuccccuuagcugcccuuguaugacccggauuugcuaugcaaaacaaucuaucccagguuc

SEQ ID NO: 12807 - RNA, 62 nt, Human
aacacacaguucgucucugaggaaaguaaaauaaauggaauaagaguaaauuggguaaggag

SEQ ID NO: 12808 - RNA, 62 nt, Human
ugcucacgcaaguguaaugacagaccugaauaaaauguauuaagcagcagugaucuuuccuc

SEQ ID NO: 12809 - RNA, 62 nt, Human
uucagaaagugauccugguuucuaggucuuugcucugcaggaucgggaucagagcgugggag

SEQ ID NO: 12810 - RNA, 60 nt, Human
gcuugagacaguccaagcuucagcucuggagggcggaggaaagcucauggcauacccacc

SEQ ID NO: 12811 - RNA, 62 nt, Human
ggcgcuguggaaauugggucuugggcuggguggcaucuggcagucauggguaacacuugcuu

SEQ ID NO: 12812 - RNA, 62 nt, Human; identical to SEQ ID NO: 10116

SEQ ID NO: 12813 - RNA, 62 nt, Human
agggggcaacuccaccuggacugaugggcacaggaggcaccaauagcgauuauugggggcaa

SEQ ID NO: 12814 - RNA, 62 nt, Human
gucugggcccuucagggagccgcggauuuuuauguucagaaagugauccugguuucuagguc

SEQ ID NO: 12815 - RNA, 62 nt, Human
ggaagcagccugugcggaaacgccagugacacguacacaccacguccuggucuuuguuugag

SEQ ID NO: 12816 - RNA, 51 nt, Human; identical to SEQ ID NO: 11131

SEQ ID NO: 12817 - RNA, 62 nt, Human
cggcuuuuuauaaguauacugcauuuuuugagccuaucauuaauuagcuuaguaugaaagau

SEQ ID NO: 12818 - RNA, 62 nt, Human
ucuuuccuauccuuucuuccccccucacugugaaaaauaacaguccaccccaagucauacac

SEQ ID NO: 12819 - RNA, 62 nt, Human
aaccgucuuauuuuuuuaaaaguucuguugcuuguauuaacacgaaacuagagagaaauagu

SEQ ID NO: 12820 - RNA, 60 nt, Human
acauggguuuccuuauugaaaaaucaguguauuagucauaaaacaccaucauuaagaaua

SEQ ID NO: 12821 - RNA, 62 nt, Human; identical to SEQ ID NO: 9475

SEQ ID NO: 12822 - RNA, 56 nt, Human
uaauucugugagaguugagcucauuuucuaguuggaagaaugugauauuuguugug

SEQ ID NO: 12823 - RNA, 62 nt, Human
auuaaaaaauaaaucacugccaggcuucauucuuccauaugauccucuaaaaauggacacuu

SEQ ID NO: 12824 - RNA, 62 nt, Human
uguuuuggucauugcauuugcacuuucauggacaacuuuuaauuugaucagcaagacaucuu

SEQ ID NO: 12825 - RNA, 62 nt, Human
ggaccagucaggggaauccccuuauuucuguuuugcauaugaggaacccuagagcagccagg

SEQ ID NO: 12826 - RNA, 60 nt, Human
ggcuccuuaaaugccccgucucuuuguaaacugauauucagccagcaaugccuaagacuu

SEQ ID NO: 12827 - RNA, 62 nt, Human
ugaaaagaaggugaauauuuugcacuuuugauacucuuaggaacaaauaacuuauuuggcaa

SEQ ID NO: 12828 - RNA, 52 nt, Human
ccggcuccgccccugcagcccacacagcacaacgucuuaccgugccuauuac

SEQ ID NO: 12829 - RNA, 62 nt, Human
aaauauaaucugauaauuaaugguuuguggaauccauuaugaagugcaauuagauagaugua

SEQ ID NO: 12830 - RNA, 56 nt, Human
guuagaaaaugacagaugguagagacuuccauagaauuaagaggguucucauggag

SEQ ID NO: 12831 - RNA, 62 nt, Human; identical to SEQ ID NO: 12829

SEQ ID NO: 12832 - RNA, 56 nt, Human; identical to SEQ ID NO: 12830

SEQ ID NO: 12833 - RNA, 62 nt, Human; identical to SEQ ID NO: 12829

SEQ ID NO: 12834 - RNA, 56 nt, Human; identical to SEQ ID NO: 12830

SEQ ID NO: 12835 - RNA, 62 nt, Human
uaugagcuauacuuuaacaugacuuaauuuugaaaucguauaaaggauguauuaaaauuuuu

SEQ ID NO: 12836 - RNA, 62 nt, Human
gccuggccaauauggugaaaccccaucucuacuaagaauacaaaaaauuagcugagcauggu

SEQ ID NO: 12837 - RNA, 62 nt, Human
gugguaccacagcucugagagcagauaccagggguacuaagaggugcuuagacaagggcugg

SEQ ID NO: 12838 - RNA, 62 nt, Human
cagccuggccaacauggugaaacuccaucucuccuaaaaaaaaaaaaaaaaaaaaaaaaaaa

SEQ ID NO: 12839 - RNA, 62 nt, Human
cucucccugaggguacaaaaggccaccccaggggcaauaccaugaguacacauuuguaaauu

SEQ ID NO: 12840 - RNA, 61 nt, Human
ccccuuccuaaacccuuaaaugcccuuagucuguaagagaaugucccugaccgaaaucggc

SEQ ID NO: 12841 - RNA, 62 nt, Human; identical to SEQ ID NO: 9304

SEQ ID NO: 12842 - RNA, 60 nt, Human
aaaaaaccugacaaaagaaauaguaugaaaaguagaaaaaugucacguuuccauaucucc

SEQ ID NO: 12843 - RNA, 62 nt, Human
gcauucauaaaugggaauagaacgugaaagccagcucuuucagaauauccucuauuaauacu

SEQ ID NO: 12844 - RNA, 62 nt, Human
acccuugcaguggccauuuaaaaaugcauagcaggugacccacugcgucccuuugcguucag

SEQ ID NO: 12845 - RNA, 62 nt, Human
gaggguugggggauggaagcauuauuccagguggacgggauagaauccagccucugccugga

SEQ ID NO: 12846 - RNA, 62 nt, Human
uggcuuuuuucuuuccuuuuuucaaauugacuuuuauagguauuuccugaaaguguauacaa

SEQ ID NO: 12847 - RNA, 62 nt, Human
auuagugaugguggugguacaguuggaauuagugccaugucauacacaaauguuccacaagg

SEQ ID NO: 12848 - RNA, 62 nt, Human
ugguuaggaaggauguucaaacggucccacccaagccugucaccucugcucauccuccaaga

SEQ ID NO: 12849 - RNA, 62 nt, Human
uccucaugacauaccgcaaauaucugugggguccuguugaaaagaacaaaauaaaggagccc

SEQ ID NO: 12850 - RNA, 60 nt, Human
ggcgggggcagugccuuacacaugcuugauucccacgcuacccccugccuugggaggugu

SEQ ID NO: 12851 - RNA, 62 nt, Human
ccgugccucaauuuccccaucuguaaacuguagauaugacuacugaccuaccucgcaggggg

SEQ ID NO: 12852 - RNA, 59 nt, Human
gacucucaucccuauuuuaccuauuuccauuuucgucuaucccaucuaugaggugauga

SEQ ID NO: 12853 - RNA, 62 nt, Human; identical to SEQ ID NO: 11631

SEQ ID NO: 12854 - RNA, 59 nt, Human
gauacguuuggucuuucaugcugaaaaauaaauaauaaagccugucccgugucuacugc

SEQ ID NO: 12855 - RNA, 62 nt, Human
cagggucggcccucagcucagcccgccaggagucagggaggagacucgcugggagugggagg

SEQ ID NO: 12856 - RNA, 60 nt, Human
cggcuccucugcaccccgugauucugcccacgcuccuccaccacgaggcacugaccugcg

SEQ ID NO: 12857 - RNA, 62 nt, Human; identical to SEQ ID NO: 12855

SEQ ID NO: 12858 - RNA, 62 nt, Human; identical to SEQ ID NO: 10709

SEQ ID NO: 12859 - RNA, 62 nt, Human
gaguggccgguccccgcugugccaggugggcaggcaggagcaaggccugcgagggaggaacg

SEQ ID NO: 12860 - RNA, 62 nt, Human
cagguggccguccaaagacagccaacggagcugccucgcagaaucagccagugggcaggugg

SEQ ID NO: 12861 - RNA, 62 nt, Human
gagaauuaacaauaaaagugugaagagcgauugugaggaacaagccugggagugaucauucu

SEQ ID NO: 12862 - RNA, 53 nt, Human
gucugcuucgacagaacugaguguauaccuuuacccucaaguaccacuaacac

SEQ ID NO: 12863 - RNA, 62 nt, Human
cagguccaggggcugugggggcggggcgccgggucgggccgagugcagcaccagguucuuga

SEQ ID NO: 12864 - RNA, 62 nt, Human
acagccuucugaaguuacucauuauaagucaagcaaacgagaaguacgaacaucugauucuu

SEQ ID NO: 12865 - RNA, 62 nt, Human
ugaacccucugucccugagcuaacccacauacuagcagaggaggaagucagagucggccacu

SEQ ID NO: 12866 - RNA, 62 nt, Human
cucaugucaguaugagcagaaacauuucaaccaugagauaaacccccaucugaccagaaaca

SEQ ID NO: 12867 - RNA, 62 nt, Human
aucuaaaugcauucauucuaaaaaauuuuuugaaccagauaaauaaaauuuuuuuuugacac

SEQ ID NO: 12868 - RNA, 60 nt, Human
ccgugcugccugcgccagccccaggcugcugaggagcagaggccagaccagggccgaucu

SEQ ID NO: 12869 - RNA, 62 nt, Human; identical to SEQ ID NO: 12223

SEQ ID NO: 12870 - RNA, 60 nt, Human
acucaugacccaaauccuuccaagacacaaaugaagcuaaucuucuuccccucccuuucc

SEQ ID NO: 12871 - RNA, 62 nt, Human; identical to SEQ ID NO: 12757

SEQ ID NO: 12872 - RNA, 59 nt, Human
auuuuacagaugggagaacagucucagcacaauugagcagcuugcccagcuaggagcag

SEQ ID NO: 12873 - RNA, 62 nt, Human; identical to SEQ ID NO: 11689

SEQ ID NO: 12874 - RNA, 58 nt, Human
ucaggagacccguggggcacggaacaggagggucuggacccuguggcccagccaaagg

SEQ ID NO: 12875 - RNA, 62 nt, Human
gcccccaaugccacccuugcaguggccauuuaaaaaugcauagcaggugacccacugcgucc

SEQ ID NO: 12876 - RNA, 56 nt, Human
acuguuuauuuuuguuuguuuguuuguuuguuuuaaucucuacagcacauuuaaug

SEQ ID NO: 12877 - RNA, 62 nt, Human
cuaagaaagccacugcuuucucaucaucacucuauaccaauacuuauuucuggccaaaugaa

SEQ ID NO: 12878 - RNA, 62 nt, Human
caccugguaucucgagugccugcaguugcaaguauguuuacaccugguguccaauuuuguau

SEQ ID NO: 12879 - RNA, 62 nt, Human; identical to SEQ ID NO: 11223

SEQ ID NO: 12880 - RNA, 60 nt, Human
gugugugcgagugugugggcuggugugugaauaucuauaaauaaguauauaugguguaua

SEQ ID NO: 12881 - RNA, 62 nt, Human; identical to SEQ ID NO: 11303

SEQ ID NO: 12882 - RNA, 62 nt, Human
gccauuuuacagaugggagaacagucucagcacaauugagcagcuugcccagcuaggagcag

SEQ ID NO: 12883 - RNA, 62 nt, Human; identical to SEQ ID NO: 11303

SEQ ID NO: 12884 - RNA, 62 nt, Human; identical to SEQ ID NO: 12882

SEQ ID NO: 12885 - RNA, 62 nt, Human; identical to SEQ ID NO: 11303

SEQ ID NO: 12886 - RNA, 62 nt, Human; identical to SEQ ID NO: 12882

SEQ ID NO: 12887 - RNA, 62 nt, Human; identical to SEQ ID NO: 11303

SEQ ID NO: 12888 - RNA, 62 nt, Human; identical to SEQ ID NO: 12882

SEQ ID NO: 12889 - RNA, 62 nt, Human
gugccuggcuugaguaaaaaucugaagccagaugcuucaggauuaagaccccaugcucuggc

SEQ ID NO: 12890 - RNA, 57 nt, Human
uagcccagaagaggauggcucauccugggugggacgauggcuccugccuugaaagac

SEQ ID NO: 12891 - RNA, 62 nt, Human
cccaggcaggccaccauauucagugcuguggccugggcaagauaacgcacuucuaacuagaa

SEQ ID NO: 12892 - RNA, 62 nt, Human; identical to SEQ ID NO: 12400

SEQ ID NO: 12893 - RNA, 62 nt, Human
gcugccggugccccguacccuguauuuauucuuuuaacaauaacaaaagccauuuauuuauu

SEQ ID NO: 12894 - RNA, 56 nt, Human
caguguuuucuacuuuggcaacucacgucacacacauauuacacacaugugcgcau

SEQ ID NO: 12895 - RNA, 62 nt, Human
auuuaaaaccaguaaggagacuugaaauucagaaaaucaacacauuuuuaaaugacuaacuu

SEQ ID NO: 12896 - RNA, 55 nt, Human
acaaguuuguugagcuuuaaaauguauuugaaguaauauuuaaauaggcauuuaa

SEQ ID NO: 12897 - RNA, 62 nt, Human
ucagcaccuggaaccuggaucacauaauagaaaagaaacgcaccaucauuccuacacuggug

SEQ ID NO: 12898 - RNA, 62 nt, Human
cugagccaccuuuacucugcucuaugccaggcugugcuagcaacacccaaagguggccugcg

SEQ ID NO: 12899 - RNA, 62 nt, Human
cuucucuucuccacccagaguaccaucacuauaaucaacgaacuucaguuuuucucuuauag

SEQ ID NO: 12900 - RNA, 62 nt, Human
aauguuuaugagccagacaaauggaggaauaugacggaagaacauagaacucugggcugcca

SEQ ID NO: 12901 - RNA, 62 nt, Human
ccccccucaaaacccacagguuccuuucuuuuccauccaacaauuaaagaucuuugacacua

SEQ ID NO: 12902 - RNA, 61 nt, Human
cugaccaacagccagcucuguccuuccccccaggaaacacauguucauuugugugaucaug

SEQ ID NO: 12903 - RNA, 62 nt, Human
cugcuccagacagcaaucagugugccaaacuuuugcgaagcacaaggaccagcaccgguaau

SEQ ID NO: 12904 - RNA, 59 nt, Human
uuagugauauuuggaaauaccuggauauuugcuagaggaaaaaugaaagcaaaacuucg

SEQ ID NO: 12905 - RNA, 62 nt, Human
ucuugccagccucaggcuugagggagggcugggcuagaaagaccacuggcagaaacaggagg

SEQ ID NO: 12906 - RNA, 60 nt, Human; identical to SEQ ID NO: 9643

SEQ ID NO: 12907 - RNA, 62 nt, Human
gucaccugggucugccgggauggguugggggggcaggugccaggccucacugcugugaaucu

SEQ ID NO: 12908 - RNA, 62 nt, Human
gccugcucaccauggcccagcgccacucuguccuccgacucaggugagggggcagcccacag

SEQ ID NO: 12909 - RNA, 62 nt, Human; identical to SEQ ID NO: 11607

SEQ ID NO: 12910 - RNA, 58 nt, Human
aauauuucccucacauuaaaagcaaauuuuuaauaucaggcucgaagagcaaaaugau

SEQ ID NO: 12911 - RNA, 62 nt, Human
guuauuguuauguaucacuugcuaaaaauauuguuuuaaucagagauaaccucuuuaaaaaa

SEQ ID NO: 12912 - RNA, 60 nt, Human
auacccaggucagauugacgggaccagaagggaacaucgacuucuaauccagcuuucuug

SEQ ID NO: 12913 - RNA, 62 nt, Human
ccauagcacaccccuuagcgcuugccuagguugcugaaaacagggaggcaccugguaucucg

SEQ ID NO: 12914 - RNA, 62 nt, Human
ugugauuucuagcucagccucccaccgucuuccuccuacacaccaaugaugagccucaugcc

SEQ ID NO: 12915 - RNA, 62 nt, Human
aacuauuaccuuaucuauaaauguuacccugggguauaaucauguuguagguacuuaaaugc

SEQ ID NO: 12916 - RNA, 60 nt, Human
uuuuuauggauuuuucagcucauuucagaugaaggaacuaagucauugugaacugucucu

SEQ ID NO: 12917 - RNA, 62 nt, Human
acggaacuccagauccugaguaauccuuuuagagcccgaagagucaaaacccucaauguucc

SEQ ID NO: 12918 - RNA, 61 nt, Human
ugcuccuagcugcacgguggcugcuggccacaccacggcaaguggcagcaggggccggccc

SEQ ID NO: 12919 - RNA, 62 nt, Human
gcgaggccaaggagaguggaucaccugaggucgggaguuccagaccagccuggccaacaugg

SEQ ID NO: 12920 - RNA, 62 nt, Human
uggaaaacccaguguccaucuuuccacccucccugaucuccagaaccuucgacugacccccu

SEQ ID NO: 12921 - RNA, 62 nt, Human
uguaggcaaaguacacugagaacaaaggagaaggagcaacuaugucucccuaggauggcccc

SEQ ID NO: 12922 - RNA, 60 nt, Human
ucuaaauguuucugcuucccagaaugcaccugacuuaugaaauggggauaauacucccag

SEQ ID NO: 12923 - RNA, 62 nt, Human; identical to SEQ ID NO: 9410

SEQ ID NO: 12924 - RNA, 62 nt, Human
cauaaaggagaaucuacgcugguccucaggacguguuaaagagaucugggccucauguagcu

SEQ ID NO: 12925 - RNA, 62 nt, Human
uggguaaucagauuuccaacuuaugccuuccagaaaaaaacacuacugccuaacacaaaucu

SEQ ID NO: 12926 - RNA, 61 nt, Human
aucaggucguugucauccuuucccucccugaccugucacgagccucugcaggugccugcuc

SEQ ID NO: 12927 - RNA, 62 nt, Human; identical to SEQ ID NO: 10853

SEQ ID NO: 12928 - RNA, 62 nt, Human; identical to SEQ ID NO: 10854

SEQ ID NO: 12929 - RNA, 62 nt, Human; identical to SEQ ID NO: 10853

SEQ ID NO: 12930 - RNA, 62 nt, Human; identical to SEQ ID NO: 10854

SEQ ID NO: 12931 - RNA, 62 nt, Human; identical to SEQ ID NO: 10073

SEQ ID NO: 12932 - RNA, 60 nt, Human
ggcaacacugaauaggaguuaagggaauggcacgaucacagugagagagcugcacucacc

SEQ ID NO: 12933 - RNA, 62 nt, Human
ggcuucccgggcgcucugaguggaagccucccaggcgcgcgagagagcugggucccgggaga

SEQ ID NO: 12934 - RNA, 62 nt, Human; identical to SEQ ID NO: 11118

SEQ ID NO: 12935 - RNA, 62 nt, Human
gugugaugccccuucagacaguccccauccuggagcgcgccacaugcagaguggaccuggcc

SEQ ID NO: 12936 - RNA, 62 nt, Human
cugacaaaggcagcacuuauuuccugggcuggugcgccccaaaacacggccccgacacuuag

SEQ ID NO: 12937 - RNA, 62 nt, Human; identical to SEQ ID NO: 10538

SEQ ID NO: 12938 - RNA, 60 nt, Human
uauuauuauuauuuuuuagaaacuuggaauacugucgucauggcuaagagaacaaaucug

SEQ ID NO: 12939 - RNA, 62 nt, Human
cgccccgccggcaaggggcccccagccucccccaacccgggauccucuugacuuccaaggac

SEQ ID NO: 12940 - RNA, 60 nt, Human
agccaugaucugcaggggucugggagucaggcccggccuauugcuugggucucucuccau

SEQ ID NO: 12941 - RNA, 62 nt, Human
gugagucauacuccccacaaagccacaauggccccccgcgaagaggggcagaguuaaacauu

SEQ ID NO: 12942 - RNA, 61 nt, Human
ggccacgcccucccugagccgagggggauggggaacgcggacgagaagggcguggguccug

SEQ ID NO: 12943 - RNA, 62 nt, Human
guuggggagagguguucgguuuccccagccuguuaaugaacagccauacguguaagcuuuuu

SEQ ID NO: 12944 - RNA, 60 nt, Human
ugacacuucauuguaauucacaguguaaauuuaauccaaacugaaauuuuguuucaacug

SEQ ID NO: 12945 - RNA, 62 nt, Human
auucucuguaacuucaguucugguguuuuccuugaguaucuacuuggcuucucgugguuuuu

SEQ ID NO: 12946 - RNA, 61 nt, Human
uccugcgcccuucauugccacacuuggugggaccaugaacaucuuuagugucugagcuucu

SEQ ID NO: 12947 - RNA, 62 nt, Human; identical to SEQ ID NO: 10512

SEQ ID NO: 12948 - RNA, 62 nt, Human; identical to SEQ ID NO: 10513

SEQ ID NO: 12949 - RNA, 62 nt, Human
cgcccuacugcaugcagccaaauaaaaggugugcccagucuaaccugugcccugugguuucu

SEQ ID NO: 12950 - RNA, 62 nt, Human
gcagccgggggccgguggccagagcgagggcaccagccacgaaggacggaggcgggcggggc

SEQ ID NO: 12951 - RNA, 62 nt, Human
aagaccacugcuaccuguuuacccacccuggucccucccagacaagcaaggccucugauuuc

SEQ ID NO: 12952 - RNA, 62 nt, Human
caaaagcaaagcauuaguggcuauggucuguaaaaugaaacaaaaaaacuuuauuucacuau

SEQ ID NO: 12953 - RNA, 62 nt, Human
gcacuccagccugggcaaaaaagcaaaacuccaucucaaagagaaaaaaaaaaaagaccggg

SEQ ID NO: 12954 - RNA, 60 nt, Human
gacaguauaauugaaggauuuuuuugauucuugcaaccgacaguuaggauggccuuugaa

SEQ ID NO: 12955 - RNA, 62 nt, Human
agugacggccaugcagguggccguccaaagacagccaacggagcugccucgcagaaucagcc

SEQ ID NO: 12956 - RNA, 58 nt, Human
aaguaacuguuuuuccccuucaggugcugucgggguaagguuuuagacucucaugcuu

SEQ ID NO: 12957 - RNA, 62 nt, Human
uuuggcugcagauucaaauaggcaguucucuuauuuggucgacuuuugugaaugugugacau

SEQ ID NO: 12958 - RNA, 62 nt, Human
ccucccccuggaacugggacuggucucggucugcugacgucagggucagcucccccgcggag

SEQ ID NO: 12959 - RNA, 62 nt, Human
gcaguccagccccccucuucuaggaugagccacuguagaucauuaaaguuccuccuugagag

SEQ ID NO: 12960 - RNA, 61 nt, Human
uaugagcuauacuuuaacauacuuaauuuugaaaucguauaaggauguauuaaaauuuuug

SEQ ID NO: 12961 - RNA, 62 nt, Human
agugggugucucugcaucacccacagccgcagcuguaaggcacgcuggaaggcacacgccug

SEQ ID NO: 12962 - RNA, 61 nt, Human; identical to SEQ ID NO: 10203

SEQ ID NO: 12963 - RNA, 62 nt, Human
gagacagcaugucaccugggacucugccagugcagaauaugaacaaugccauguucuugcag

SEQ ID NO: 12964 - RNA, 62 nt, Human
ggaugaagggcaggccggcccuugaugugccauuucugaauaauagucacugccgccgaguc

SEQ ID NO: 12965 - RNA, 62 nt, Human
cacacugcgcggcuuccaccuuuacugacggagcaugcgcgaggccgcaccggccaaucucc

SEQ ID NO: 12966 - RNA, 60 nt, Human
uaagugacuaaccaagauuauuucauuuuaaaaccauagaauaaaaaugacaccugagcu

SEQ ID NO: 12967 - RNA, 62 nt, Human
uuggucuuuggcuccccuuuaucuggauucugagcacgcugacuguccuguuaaugccuucc

SEQ ID NO: 12968 - RNA, 62 nt, Human; identical to SEQ ID NO: 11015

SEQ ID NO: 12969 - RNA, 62 nt, Human
uaauugccauuacucccaguuaguuacccuugucauuuggcauuauuuucagaaccacauuu

SEQ ID NO: 12970 - RNA, 56 nt, Human
aguauuuugcauggggguuagagaagguuugagguagacucugaccgucucauaaa

SEQ ID NO: 12971 - RNA, 62 nt, Human
agauucgaaccugcagcacuuaaaaguuggaugacguauggacuugaacacguuugucuuga

SEQ ID NO: 12972 - RNA, 61 nt, Human
cuauuuucucuguaagugaagauugucguauuccaagucuaaaauacaccuggaucugucu

SEQ ID NO: 12973 - RNA, 62 nt, Human
ccaugaauccugcugucccugcugccguuuaccagacaaucauauguuuuuguuaaauuugc

SEQ ID NO: 12974 - RNA, 62 nt, Human
uucccuaugccuacaaaggaaaugaguggcuuggauacgauaacaccaagaguuuccaaauc

SEQ ID NO: 12975 - RNA, 62 nt, Human; identical to SEQ ID NO: 9482

SEQ ID NO: 12976 - RNA, 62 nt, Human; identical to SEQ ID NO: 9483

SEQ ID NO: 12977 - RNA, 62 nt, Human
gaagauucaauauuaacuagcuugaagccugaccuagccagaagugccuguccgcugcagcc

SEQ ID NO: 12978 - RNA, 59 nt, Human
cugagcauggggugggcagugaggucccuguaccagcgacuccugccccgguucaaccc

SEQ ID NO: 12979 - RNA, 62 nt, Human; identical to SEQ ID NO: 12105

SEQ ID NO: 12980 - RNA, 62 nt, Human
gacacacuuuauuuccuaagggcuggccaaggcucccauagaggcgcugugucagugaagau

SEQ ID NO: 12981 - RNA, 62 nt, Human
cugauaaaugaagaaaaguauugcaccuuugaaaugcaccaaaugaauugaguuuguaauua

SEQ ID NO: 12982 - RNA, 56 nt, Human
cacaccugggcccgggcaggccagcuucgugcuggaggaacuugcugcugugccug

SEQ ID NO: 12983 - RNA, 62 nt, Human
cacuugcaggggucccugcugcagcucgaggcccccgaccaacuccccucgugucagcucag

SEQ ID NO: 12984 - RNA, 61 nt, Human
guauauuuauauucauuucuucuguucuccuucuguuauuauacuuaaucuucuaaacuaa

SEQ ID NO: 12985 - RNA, 62 nt, Human
gucuccaaaaaaaaaagugcuuuuugaaaauguugagguugaaaugaugggaaccaacauuc

SEQ ID NO: 12986 - RNA, 62 nt, Human
aggacuuuuaucugucuuggucaccccggccaggccccggaagcagcagccagggauggucc

SEQ ID NO: 12987 - RNA, 62 nt, Human
gcgggggagcugccugcagaagagccagcuggcgugucgggaaggauccaggaucugcaaac

SEQ ID NO: 12988 - RNA, 62 nt, Human
ugugaucauugaucagauguggugagugaguaggggacucgacuugcgggaugcaguuuugc

SEQ ID NO: 12989 - RNA, 62 nt, Human
cuggcuccuuaaaugccccgucucuuuguaaacugauauucagccagcaaugccuaagacuu

SEQ ID NO: 12990 - RNA, 62 nt, Human
uuaaaaaaguaaguaccacucaggccaacaagccaacgacaaagccaaacucugccagccac

SEQ ID NO: 12991 - RNA, 62 nt, Human; identical to SEQ ID NO: 12989

SEQ ID NO: 12992 - RNA, 62 nt, Human; identical to SEQ ID NO: 12990

SEQ ID NO: 12993 - RNA, 62 nt, Human
uuagaaacuaacuacuaacuagucuuuggaauucgugaccuauggagacaguaauuaucaau

SEQ ID NO: 12994 - RNA, 61 nt, Human
accgguacaucccguucacacaugggaagagaagguacagaggcaaggaggaugccggcaa

SEQ ID NO: 12995 - RNA, 53 nt, Human
gauccuucaucaacgucuagcggccccgcgggacuggggacugagcccaggag

SEQ ID NO: 12996 - RNA, 62 nt, Human; identical to SEQ ID NO: 10210

SEQ ID NO: 12997 - RNA, 62 nt, Human
ggcagagaugcagagccuaaaggaccagguacaggagcugcaccgagaccucaccaagcacc

SEQ ID NO: 12998 - RNA, 62 nt, Human
gccaccgcaccuggccccuggugcugggauuacacgccgugaacccgccucagccucccaaa

SEQ ID NO: 12999 - RNA, 62 nt, Human
cagguacugcacuggacacugcucaucccugggugucaggcagguggcugcacccuaggcca

SEQ ID NO: 13000 - RNA, 60 nt, Human
aucagaguugcuauaaaauucaguaaaaagcucauagccaaacggcugugcucagaugga

SEQ ID NO: 13001 - RNA, 62 nt, Human
cggaaggaagaucacauguccccagagaggcacccccaggcaagcucgagggggccacaccg

SEQ ID NO: 13002 - RNA, 60 nt, Human
ugguuuuccuuuugcagcacacugggcagucucccuauaaaacaaaaaccccaccuucug

SEQ ID NO: 13003 - RNA, 62 nt, Human
cuucagacaaaggauuucucaaccuuuggucaguuaacuugaaaacucuugauuuucagugc

SEQ ID NO: 13004 - RNA, 62 nt, Human; identical to SEQ ID NO: 9927

SEQ ID NO: 13005 - RNA, 62 nt, Human
ugcuugguugaacaagggaaucacaagaaaacgaaaaugcaaaaacugaacuucgggggucg

SEQ ID NO: 13006 - RNA, 57 nt, Human
agcugauccaguaggugcagcugccgcagccgggggaggccugcccgggaaggcugc

SEQ ID NO: 13007 - RNA, 62 nt, Human
ugauuugauugugauuagagaaccuuggacauuuugcugcuaaagaaucuuuuuuccccucu

SEQ ID NO: 13008 - RNA, 60 nt, Human
cagccagagcugcugccagagcugcguucccugcaguggagguggacuggacacccacgu

SEQ ID NO: 13009 - RNA, 62 nt, Human; identical to SEQ ID NO: 11155

SEQ ID NO: 13010 - RNA, 62 nt, Human
uauauauauguuuguguauauauauacacauaugcauacauaugauuuuuuuuuuucauuua

SEQ ID NO: 13011 - RNA, 62 nt, Human
auccgcggggacccugccgagggggcugucaugcgguuuccaaggugcacauuuuccacgga

SEQ ID NO: 13012 - RNA, 61 nt, Human
cacuucauucucugaccuuucucucuccucauuucggugcauguccuuucugcagcugccu

SEQ ID NO: 13013 - RNA, 62 nt, Human
cucccaaagugcugggauuacaggcgugagccaccgcgcccagccagaacaucuguuuuuac

SEQ ID NO: 13014 - RNA, 61 nt, Human
ccguucauguguuggaggccaaauguggcaaaccaaccccaggcccacccagagcgagcaa

SEQ ID NO: 13015 - RNA, 62 nt, Human
cuucaagcugauccaguaggugcagcugccgcagccgggggaggccugcccgggaaggcugc

SEQ ID NO: 13016 - RNA, 60 nt, Human; identical to SEQ ID NO: 12012

SEQ ID NO: 13017 - RNA, 62 nt, Human
acucaauguauauaucuuauaucauaagauguaugcuagagauaaacuuuccaauuuuuaag

SEQ ID NO: 13018 - RNA, 55 nt, Human
gcccacccucuccuggugcugccuggggaggcaaaucaugcucacuccggcgggc

SEQ ID NO: 13019 - RNA, 62 nt, Human
cagcgaggagaaucgcugccccgccccggaccauucagcggaccgcgggcgcccgguuccca

SEQ ID NO: 13020 - RNA, 62 nt, Human
aucuaccucacaggcccacccccugccgggcaugccgugggaucaugggcagggaaggcucu

SEQ ID NO: 13021 - RNA, 62 nt, Human
agcaacaagcaagagagaaaaaaguguugugaaaggcgucgaaaagaaaagggauagagauu

SEQ ID NO: 13022 - RNA, 62 nt, Human
gucaagagccugugguccagcaugccuggccugggcgggcuaccucugagaacggcugaaau

SEQ ID NO: 13023 - RNA, 62 nt, Human
ggggccccggagaacccugucccugcguguggccacuccucagcauccuccccacccaccau

SEQ ID NO: 13024 - RNA, 62 nt, Human; identical to SEQ ID NO: 12399

SEQ ID NO: 13025 - RNA, 62 nt, Human
ugcaccugacuuaugaaauggggauaauacucccaggaaauagcgcaggacaucacaaggac

SEQ ID NO: 13026 - RNA, 61 nt, Human
ccacccccuagccuguggggugcaucugcgaaccagggugaagucacaggucccggggugu

SEQ ID NO: 13027 - RNA, 62 nt, Human; identical to SEQ ID NO: 9723

SEQ ID NO: 13028 - RNA, 62 nt, Human
uagugccuuugaagagcugucugccugagcaacucuauuucaggugccccacaccggcaagu

SEQ ID NO: 13029 - RNA, 62 nt, Human
aguccacugugggugccaucggguccccacgcuccuuugcgagagggguggccuggccuucg

SEQ ID NO: 13030 - RNA, 62 nt, Human
uuuuuuuuaauaucacgguuaaaagcugcugccaguuagccaagacauuauccaccaaauug

SEQ ID NO: 13031 - RNA, 62 nt, Human
cauguauuuuaugauacuugaauuuuuugaaaugggcauuuauuuuauaacauguuaaaaug

SEQ ID NO: 13032 - RNA, 62 nt, Human
agacuuuaucgcucuguggcucauuguuacuggaauauucuaaaacucuuguucacaugcua

SEQ ID NO: 13033 - RNA, 62 nt, Human
uugagacugaaacaggaaaggccauaaaauaucugguucauaucaccuguuggacauuuccu

SEQ ID NO: 13034 - RNA, 61 nt, Human
cauguguugauuuuauuugaccccuggaguggugggucucaucuuucccaucucgccugag

SEQ ID NO: 13035 - RNA, 62 nt, Human
cacaaaguuaaacaaacaaaugggggcaaacugagguagcgauugcguguguguaagggaca

SEQ ID NO: 13036 - RNA, 60 nt, Human
ucugcaccugaaaagugacccgcggaaacucuauggcggauuuuuuuuuuaacuuucuuc

SEQ ID NO: 13037 - RNA, 62 nt, Human
uaccuggccccagcacucucccaucuguucuucaggaaccgacuccucuccaguugcaacac

SEQ ID NO: 13038 - RNA, 61 nt, Human
aggcccugccccuggcuccuuaaaugccccgucucuuuguaaacugauauucagccagcaa

SEQ ID NO: 13039 - RNA, 62 nt, Human
uauuuucaguuuuuaaacgugcaguagugcaguggcgcgauaagucuugcucuguugcccag

SEQ ID NO: 13040 - RNA, 62 nt, Human
aacagcuguagagaugaaaacugggcucugcuggcgagacgacaguguacuugguaccaucc

SEQ ID NO: 13041 - RNA, 62 nt, Human
ccccaccccaugagcuggcaccagagccccgcgcccgcuguaauuauuuucuauuuuuguaa

SEQ ID NO: 13042 - RNA, 62 nt, Human
agaaacuuugucaucggaaaaacuuuucuuguaugcaugagacucaacaucaggauccacag

SEQ ID NO: 13043 - RNA, 62 nt, Human
gcuccuguggugagggcagggugcuccacagacaccuccagacccagccaagaacuacaggg

SEQ ID NO: 13044 - RNA, 62 nt, Human
gacuguuuucauuucuguuuuuagcagagacaugcaacaacaacacacacgcacacacgcac

SEQ ID NO: 13045 - RNA, 62 nt, Human
ucugaaaucauccauuuggggacaaauccacauuggggucuagaaacauccacguaucucau

SEQ ID NO: 13046 - RNA, 62 nt, Human; identical to SEQ ID NO: 11642

SEQ ID NO: 13047 - RNA, 62 nt, Human; identical to SEQ ID NO: 11873

SEQ ID NO: 13048 - RNA, 60 nt, Human
gcagcuguugcagucccccagauaccuauuauuuuacacaauuugaccuauaggaggaca

SEQ ID NO: 13049 - RNA, 62 nt, Human; identical to SEQ ID NO: 11873

SEQ ID NO: 13050 - RNA, 60 nt, Human; identical to SEQ ID NO: 13048

SEQ ID NO: 13051 - RNA, 62 nt, Human
ucagcaagagcaacugauggcugccacuuccaggccccgagagacaggccucacguaacuuu

SEQ ID NO: 13052 - RNA, 62 nt, Human
ugagcagccugagcagcggcuucgguggguauuuucugccuaagugcuacgugauccucugc

SEQ ID NO: 13053 - RNA, 62 nt, Human
cugccugcgccagccccaggcugcugaggagcagaggccagaccagggccgaucuggguguc

SEQ ID NO: 13054 - RNA, 62 nt, Human
augagaagagagcagcuccauaugacuagcucuugccgauuagucacagaaauaauuucagu

SEQ ID NO: 13055 - RNA, 62 nt, Human
ugcaucccugggcuuagaagugacggagagaagacuuguuuaguauuuugccaucagcacaa

SEQ ID NO: 13056 - RNA, 62 nt, Human
aacuccugauguuuuuucuacaaaaguccauaaaaugugaaaacuggagaagaucuuagagg

SEQ ID NO: 13057 - RNA, 62 nt, Human; identical to SEQ ID NO: 11959

SEQ ID NO: 13058 - RNA, 62 nt, Human; identical to SEQ ID NO: 10434

SEQ ID NO: 13059 - RNA, 62 nt, Human; identical to SEQ ID NO: 12326

SEQ ID NO: 13060 - RNA, 62 nt, Human
agggaggaacuuguccauuaguuuggaauuguguucuucguaaagacugaggcaagcaagug

SEQ ID NO: 13061 - RNA, 62 nt, Human
gccacauuaaauacccgugcaggcgcggagaagcaaccggcacccccuuccggccugaaagc

SEQ ID NO: 13062 - RNA, 60 nt, Human; identical to SEQ ID NO: 9267

SEQ ID NO: 13063 - RNA, 62 nt, Human
accgagacaaggaggcccuuaaaugacagccugcauuugcuagacgguuggugaguggcauc

SEQ ID NO: 13064 - RNA, 62 nt, Human
cccuggacuugucaagugaauucuuugcauguucaaaacggaaaccauugauuagaacuaca

SEQ ID NO: 13065 - RNA, 62 nt, Human
gaauuggacaacccgaacugcuuuucaaaaccagaggaaggagguucuuagccguuacucag

SEQ ID NO: 13066 - RNA, 61 nt, Human
gaaguuucuuauuuaauuccagaguacuguccucuacucuaaggcauuacuuuuaagugua

SEQ ID NO: 13067 - RNA, 62 nt, Human; identical to SEQ ID NO: 12915

SEQ ID NO: 13068 - RNA, 62 nt, Human
cgcacugugccuggguguauucuuuauacuguagauaauggagaaauuuucuaucucugucc

SEQ ID NO: 13069 - RNA, 62 nt, Human
auagucacugccgccgagucuaggauguccuguucuaacucagcccugccucggaugcacca

SEQ ID NO: 13070 - RNA, 62 nt, Human
gccaggugcucagugacuggccaucacauuaaugaaugacgagauuggaguacacugucacc

SEQ ID NO: 13071 - RNA, 62 nt, Human
gcuuuucaaaaccagaggaaggagguucuuagccguuacucagauaccagugcuggggaggg

SEQ ID NO: 13072 - RNA, 62 nt, Human
aacgagggggcgugcugggaucuuucucucugacuauacuuaguuugaaauggugcaggcuu

SEQ ID NO: 13073 - RNA, 62 nt, Human; identical to SEQ ID NO: 9245

SEQ ID NO: 13074 - RNA, 62 nt, Human
ccacgcgugcagcugucccauccagaccccgacuggccaagaccuccacguccccagagucc

SEQ ID NO: 13075 - RNA, 62 nt, Human
gucugaugcaccuguguacgugugucaagccuagccaccucagcugcagggaggcagaaggc

SEQ ID NO: 13076 - RNA, 60 nt, Human
uguuuagaaaguuugagacugaaacaggaaaggccauaaaauaucugguucauaucaccu

SEQ ID NO: 13077 - RNA, 62 nt, Human
agacccagaaagcuuuacagaaaaucauuguaagacaauuuauuaauuugagaaagucaccu

SEQ ID NO: 13078 - RNA, 61 nt, Human
aacacccugaccucuuucucuccuccuugauuguaugaauaacccugagaucaccucuuag

SEQ ID NO: 13079 - RNA, 62 nt, Human
auauaaauauccccagggacagaaaccaaggccccgagcucagggcagcugugcugggugag

SEQ ID NO: 13080 - RNA, 60 nt, Human
uucaaagacuugggggagugaaggcagagccuggugcagauggacgaggucugcagacgg

SEQ ID NO: 13081 - RNA, 62 nt, Human; identical to SEQ ID NO: 13075

SEQ ID NO: 13082 - RNA, 60 nt, Human
uuguaaaugugguauacaggacaaacuagacggccguagaaaagauuuauauucaaaugu

SEQ ID NO: 13083 - RNA, 62 nt, Human
cucagcugggauccuggaccugggaggccccugugagggccagcucuggaaaaaccugggag

SEQ ID NO: 13084 - RNA, 62 nt, Human
uugaaggucacuuuuaaaauuaagucauugaugcugcuguuacagagugugacagaggaucc

SEQ ID NO: 13085 - RNA, 62 nt, Human
ccauccgcauggaagcccacgugugcacuuaggggcccauaaauggcagaagggccccuccu

SEQ ID NO: 13086 - RNA, 56 nt, Human
gcauggucuaggugguugaaggauguaguagaaggauggaugguggaaggugggga

SEQ ID NO: 13087 - RNA, 62 nt, Human; identical to SEQ ID NO: 11155

SEQ ID NO: 13088 - RNA, 61 nt, Human
gacacuuggaaacuaaaaccuaggucuuagguacauccuaaagggagcacagaacccauca

SEQ ID NO: 13089 - RNA, 62 nt, Human
gcccggggaaaggcaagguccggcccauccccaggcaccucacaggccccaggaaaggccca

SEQ ID NO: 13090 - RNA, 62 nt, Human
acuuagcaacugccuuaucaauuacaggauuugccgguaaaagcagacucaaauauaaaggu

SEQ ID NO: 13091 - RNA, 62 nt, Human
gagaaaaggagagagcgcgugcagagacuugguggugcauaauggauauuuuuuaacuuggc

SEQ ID NO: 13092 - RNA, 62 nt, Human
cauacccugccucccucucuggcccugggagggcagcuuggagcccagguagggggcagagc

SEQ ID NO: 13093 - RNA, 62 nt, Human
ccuaaagccucccccauaaaaagggagcuguggauccacuuagaucagggcggaaccaucuu

SEQ ID NO: 13094 - RNA, 62 nt, Human
ugagccaccuuuacucugcucuaugccaggcugugcuagcaacacccaaagguggccugcgg

SEQ ID NO: 13095 - RNA, 62 nt, Human
cauggauuaaugugggaacuuggcuucaagaacacaaccuuaggaccuugggccccaaaagc

SEQ ID NO: 13096 - RNA, 62 nt, Human
agagaaauaguuucugaagccaguuuauugugaagauccccaagggggagguucgguagaga

SEQ ID NO: 13097 - RNA, 62 nt, Human
ucguguggaacuguacaaauauuuauaccaaaaauauagauaagaaaagguggggcuauacu

SEQ ID NO: 13098 - RNA, 62 nt, Human
aacauuugcuguucaaacauguuuuugaauauacauucuauaaaagauuauuugaaagacaa

SEQ ID NO: 13099 - RNA, 62 nt, Human
ugccccuuucagagacggagcaccugagaugugggaggugcagcauguuccccugggccccu

SEQ ID NO: 13100 - RNA, 62 nt, Human
uagaaucugcagaaauuaggaggcaccgagcccagcgcagcagccucggacccggauugcgu

SEQ ID NO: 13101 - RNA, 62 nt, Human
uguccccccucaaaacccacagguuccuuucuuuuccauccaacaauuaaagaucuuugaca

SEQ ID NO: 13102 - RNA, 62 nt, Human
acacucuugggagaugcauuuuccgucuggcucacagggggagggugaggcuuuguacccca

SEQ ID NO: 13103 - RNA, 62 nt, Human
uacagaaacugagacacguggagacuggaugagggcagaugaggacaggaagagaguguuag

SEQ ID NO: 13104 - RNA, 58 nt, Human
gcucgggccaaggcgcaggcugaccgcagcugccgcgacccggcgccucgcccugggc

SEQ ID NO: 13105 - RNA, 62 nt, Human
agugaggcugggaaggggaacacagaccaggaagcucggugagugauggcagaacgaugccu

SEQ ID NO: 13106 - RNA, 57 nt, Human
acaccaggcccaacccugugcuggucaagccagggcagucacagcugcuuggggccc

SEQ ID NO: 13107 - RNA, 62 nt, Human; identical to SEQ ID NO: 12958

SEQ ID NO: 13108 - RNA, 62 nt, Human
caggcgagagagaaacagcuacugcgugcgugcgcgcacgcauacacacacacacacacaca

SEQ ID NO: 13109 - RNA, 62 nt, Human
accugcgucggguggugaccguggcuggcggucacgcccucagccccuccgggcacacgugc

SEQ ID NO: 13110 - RNA, 57 nt, Human
ggagucccaauuauuuuugacuaggggaugggggacaguugacauuucugguccuac

SEQ ID NO: 13111 - RNA, 62 nt, Human
uuccucugugaggagacaagacuuggagacucagcgaugucaggccagggccauggccacac

SEQ ID NO: 13112 - RNA, 58 nt, Human
aggacaucuguguguaugugcguauuuaaauuagauuauuuauaauaaccagagccag

SEQ ID NO: 13113 - RNA, 62 nt, Human
uucucaacaguuucuuuguauaguugucugggauacgucauauuggcacuuggggacaugag

SEQ ID NO: 13114 - RNA, 61 nt, Human
gcagcaucccugcaugccguccguauacaaccccucuuugaaaaaagacacagagaauaaa

SEQ ID NO: 13115 - RNA, 62 nt, Human; identical to SEQ ID NO: 9454

SEQ ID NO: 13116 - RNA, 62 nt, Human
uuccacacaggauuccguuggugaaccuguaaaaacaaaacaaacaaaacaaaacaaaaaag

SEQ ID NO: 13117 - RNA, 62 nt, Human
agggacacuuucaggacccaguccacuguauggcauuugugaugcagaauuaugcacugaca

SEQ ID NO: 13118 - RNA, 59 nt, Human
ggaggaucgccugagcaugggaggcagagguugcagugagccaagaucgcaccauugca

SEQ ID NO: 13119 - RNA, 62 nt, Human
gcagcccugugaugucccugcauggagcuggugaauuacuaaaagaacauggcauccucugu

SEQ ID NO: 13120 - RNA, 60 nt, Human
cuaccaaguguuaauccugggaucguauuuuuauaucauauucacauauuuguuuuuuua

SEQ ID NO: 13121 - RNA, 62 nt, Human
aaccaaugcacacaguagggcuuggugaaugcugcugagugaaugaguaaauaaacucuuca

SEQ ID NO: 13122 - RNA, 60 nt, Human
acacagucgucacgucgcucuuccugcggguucuuggcgagacacagcuugagaacagaa

SEQ ID NO: 13123 - RNA, 54 nt, Human
accucuucugcuucaguugaggugacacgucucagccuuagcccugugcccccu

SEQ ID NO: 13124 - RNA, 62 nt, Human; identical to SEQ ID NO: 9254

SEQ ID NO: 13125 - RNA, 62 nt, Human
ugaggagcagaggccagaccagggccgaucuggguguccugacccucagcuggcccugccca

SEQ ID NO: 13126 - RNA, 58 nt, Human
uuaauccaaacugaaauuuuguuucaacugaauuuguaauuaacucugaauuuguuuu

SEQ ID NO: 13127 - RNA, 62 nt, Human; identical to SEQ ID NO: 9623

SEQ ID NO: 13128 - RNA, 60 nt, Human; identical to SEQ ID NO: 11590

SEQ ID NO: 13129 - RNA, 62 nt, Human
uacuauuuggccagcugcugcuguguuuuauggcaguguucagagcuugaucacguuauuuc

SEQ ID NO: 13130 - RNA, 62 nt, Human
agggucccuuugacauggacagcugcuuaucaagacacuccaucaaccccuacaguaacagg

SEQ ID NO: 13131 - RNA, 62 nt, Human
ggcguuuuaggaucuguacauagagaaauauuuaaauuuuuagaagcaaaacuuauacaaca

SEQ ID NO: 13132 - RNA, 59 nt, Human
gugucauacaagcauagacuggauuaaagaaguuuuccaguuccaaaaauuaaaggaau

SEQ ID NO: 13133 - RNA, 62 nt, Human
cugucugaauuauaaaccagccugaccuuuccuuuagcauuagauguaauaaaauaacuuug

SEQ ID NO: 13134 - RNA, 62 nt, Human
agacuuuugacuuagaaccugcuauauuaucaagcuuaccuacuguuaucucuaaaauuuuu

SEQ ID NO: 13135 - RNA, 62 nt, Human; identical to SEQ ID NO: 13133

SEQ ID NO: 13136 - RNA, 62 nt, Human; identical to SEQ ID NO: 13134

SEQ ID NO: 13137 - RNA, 62 nt, Human
gugguggcaagugccugaaaucccagguacucaggaggcugaggcaggagaaucacuugagc

SEQ ID NO: 13138 - RNA, 62 nt, Human; identical to SEQ ID NO: 9851

SEQ ID NO: 13139 - RNA, 62 nt, Human
auaaaaacaguauccguagcuaucaggaucauugcgcacucauauaugcuaagccuucuguu

SEQ ID NO: 13140 - RNA, 60 nt, Human
ggaaugaccuggaauugucaagcccugcugcggcguguuacaccgggccggacuguacag

SEQ ID NO: 13141 - RNA, 62 nt, Human
gggacucagugcccuccaugcccuggcuggcagaaacccucaacagcagucugggcacugug

SEQ ID NO: 13142 - RNA, 60 nt, Human
gcagcuuggguccuggacguugauaggaagcggaaggggaaucgcgggaagcuggcccag

SEQ ID NO: 13143 - RNA, 62 nt, Human; identical to SEQ ID NO: 10760

SEQ ID NO: 13144 - RNA, 62 nt, Human; identical to SEQ ID NO: 12251

SEQ ID NO: 13145 - RNA, 62 nt, Human; identical to SEQ ID NO: 10238

SEQ ID NO: 13146 - RNA, 62 nt, Human; identical to SEQ ID NO: 9908

SEQ ID NO: 13147 - RNA, 62 nt, Human
auuuuuaauaucaggcucgaagagcaaaaugauuauuccucauguuuuagcugaaauuaauu

SEQ ID NO: 13148 - RNA, 59 nt, Human
cggccagcucucuacaccucuauauauuauauuacuauauagccgagcuguucuuccuu

SEQ ID NO: 13149 - RNA, 62 nt, Human; identical to SEQ ID NO: 10335

SEQ ID NO: 13150 - RNA, 60 nt, Human
gggcucugaaggaaggcaagacaagcaugcauccgccguacucuuuggggcagcuggucc

SEQ ID NO: 13151 - RNA, 62 nt, Human
cugccaccucucuggccaauggcccuuucacuggccuggugacuggaaugugggcagcgccc

SEQ ID NO: 13152 - RNA, 58 nt, Human
uacgcgggugccccuucgccucccuccccuccgccagagcugccuguggccagacaca

SEQ ID NO: 13153 - RNA, 62 nt, Human
ugaaccacgugaaacugcuguuuucuaggccaaaaauggugagcgaucauuuauuucaugau

SEQ ID NO: 13154 - RNA, 62 nt, Human
ucuguucaauuccuaacgcaaacuacaauaaauggugacacacguucagaagaaaucuucuu

SEQ ID NO: 13155 - RNA, 62 nt, Human
gccuguuuuguguagaucuguuuuggaagauggcauggucuaggugguugaaggauguagua

SEQ ID NO: 13156 - RNA, 55 nt, Human
uggugaaucucuggcauguggcuuggcuuuguugagacuccaaauuccauuaucu

SEQ ID NO: 13157 - RNA, 62 nt, Human
ugaagcccucaucaaagacucaggaggccccuggcggggauagcaccguuuauuaagaaaaa

SEQ ID NO: 13158 - RNA, 60 nt, Human
auauuuauaccaaaaauauagauaagaaaagguggggcuauacuagcaacaaaaaaagaa

SEQ ID NO: 13159 - RNA, 62 nt, Human; identical to SEQ ID NO: 13011

SEQ ID NO: 13160 - RNA, 62 nt, Human
gagcggugaucaaagccgagcaaaacagcuaccagcgguacacuccccuguaguuuaggaca

SEQ ID NO: 13161 - RNA, 62 nt, Human
ugagggcugccucacugcaaauccuccccacagcgucagugaaagucguccuugucucagaa

SEQ ID NO: 13162 - RNA, 58 nt, Human
gcagguuuuaacaaaaggaugaggccagaacucuuccagaaccaucaccuuugggaac

SEQ ID NO: 13163 - RNA, 62 nt, Human
ugaaauggggauaauacucccaggaaauagcgcaggacaucacaaggaccaaaaaggcaauu

SEQ ID NO: 13164 - RNA, 49 nt, Human; identical to SEQ ID NO: 11085

SEQ ID NO: 13165 - RNA, 62 nt, Human; identical to SEQ ID NO: 13163

SEQ ID NO: 13166 - RNA, 49 nt, Human; identical to SEQ ID NO: 11085

SEQ ID NO: 13167 - RNA, 62 nt, Human; identical to SEQ ID NO: 13163

SEQ ID NO: 13168 - RNA, 49 nt, Human; identical to SEQ ID NO: 11085

SEQ ID NO: 13169 - RNA, 62 nt, Human; identical to SEQ ID NO: 9416

SEQ ID NO: 13170 - RNA, 60 nt, Human
gguugaacaagggaaucacaagaaaacgaaaaugcaaaaacugaacuucgggggucguuc

SEQ ID NO: 13171 - RNA, 62 nt, Human
gaaaaaaacaaauugggaaaugaaaaaaaaaugggaagauuaaaaagcacagggggaagaag

SEQ ID NO: 13172 - RNA, 62 nt, Human
acaugcaguuauugaagauuaggaucaaggauagacaagguauaguaguuaucuuaaaauau

SEQ ID NO: 13173 - RNA, 62 nt, Human
cuuccagaggacagcucugggguacucguuggaugucugugaguaccuggucauacggguca

SEQ ID NO: 13174 - RNA, 62 nt, Human
ccccacaauguaggaaaagaccucagggaaccucucccuggaaagacgggcagggcugguua

SEQ ID NO: 13175 - RNA, 62 nt, Human
gcuccuggaaaaaaccuuaaaaaauguuuccuccaaaucugauuucauuacauuucugaauu

SEQ ID NO: 13176 - RNA, 61 nt, Human
gucuggugggggccacucaggagaguuggguuuucagggcagagaugggcuugauuccacc

SEQ ID NO: 13177 - RNA, 62 nt, Human
cucggccuccugcgccaauacugugacuuccaaacaauguuacugcugggcacagcucugcg

SEQ ID NO: 13178 - RNA, 62 nt, Human; identical to SEQ ID NO: 10329

SEQ ID NO: 13179 - RNA, 62 nt, Human
uaacaccucuaaaaaguacuuaagauuaaaaucugguccuuaaaauuaaaugaauucagcau

SEQ ID NO: 13180 - RNA, 53 nt, Human; identical to SEQ ID NO: 12995

SEQ ID NO: 13181 - RNA, 62 nt, Human
auuggugccaagacugggugagaaauguacauuacccccuuauuauuuugacgguuuuuuuu

SEQ ID NO: 13182 - RNA, 62 nt, Human
guuuuaauuugugcuuccuuaguaaauugaaauaucagcugagagauuauuugcugcuguua

SEQ ID NO: 13183 - RNA, 62 nt, Human
cuacagaacacgcacgacgacagcaggaacaacgcggccucagccagguaaagcaagucucu

SEQ ID NO: 13184 - RNA, 53 nt, Human; identical to SEQ ID NO: 12995

SEQ ID NO: 13185 - RNA, 62 nt, Human
uuggcugauuucuugcugagugcccucuuaguuggugugugaggucuuggugggcucaggcc

SEQ ID NO: 13186 - RNA, 62 nt, Human; identical to SEQ ID NO: 9682

SEQ ID NO: 13187 - RNA, 62 nt, Human
gcgcucggccucagauuccauauuugaacaccagcugauugagagaaggggaaugagaagag

SEQ ID NO: 13188 - RNA, 62 nt, Human
gcugaaauguacacauucuggucuaguuuggucuaucuuuuaaagccugaucuggugugaau

SEQ ID NO: 13189 - RNA, 62 nt, Human
ucagucuucauuuuaaauauggauacaaaaaggauacgccgagccaaucaaagacaagcuuu

SEQ ID NO: 13190 - RNA, 62 nt, Human
cauaaugguuuccaugaauguaguacguucauacaggcuucauucaaccuggcguuccccuc

SEQ ID NO: 13191 - RNA, 62 nt, Human
caucccguucacacaugggaagagaagguacagaggcaaggaggaugccggcaaggccuucg

SEQ ID NO: 13192 - RNA, 62 nt, Human; identical to SEQ ID NO: 10742

SEQ ID NO: 13193 - RNA, 58 nt, Human
cuguuuuguauacuuguuuucaguuuucauuucgacaaacaagcacuguaauuauagc

SEQ ID NO: 13194 - RNA, 62 nt, Human
ugcaacucaacauccucuucacccugcccugccugcaguugagggggcgaagaagaacccug

SEQ ID NO: 13195 - RNA, 57 nt, Human
uuuggauucaugcuuucuggaagguuuaaauucauuaacguuaauaguuaauuauaa

SEQ ID NO: 13196 - RNA, 62 nt, Human
acuugcaaauuguuuuuuaaaaguaauuuugcauugcuuugaaauuugagcucauuugcaaa

SEQ ID NO: 13197 - RNA, 60 nt, Human
guuuacacugguuauuuauuuaugacuugaaauaguuuaaggagcuaaacagccauaaac

SEQ ID NO: 13198 - RNA, 62 nt, Human
aguucuccucaggucgugcgaaacacccccagauucuucgcacagugucuagauccgaccgc

SEQ ID NO: 13199 - RNA, 62 nt, Human
ggguagagacagggucccuuuguugcccaggcuggucuccaacuccugggcucaagcaaucc

SEQ ID NO: 13200 - RNA, 62 nt, Human; identical to SEQ ID NO: 10628

SEQ ID NO: 13201 - RNA, 62 nt, Human; identical to SEQ ID NO: 10629

SEQ ID NO: 13202 - RNA, 62 nt, Human
cuuaaugcuuuaaacuaagccacuuggauccugaauaauuuaaaucuugagcuacauuggua

SEQ ID NO: 13203 - RNA, 62 nt, Human; identical to SEQ ID NO: 10074

SEQ ID NO: 13204 - RNA, 62 nt, Human
cuauuuaagcaugugguuuuaaaaauagacaguauuuuuuaaaaaucaaaaaaugacuugca

SEQ ID NO: 13205 - RNA, 60 nt, Human
uauggcuaugaccaaagcuucuauuuugccaaaaaguuaaauaccgauaaaauggccuua

SEQ ID NO: 13206 - RNA, 62 nt, Human; identical to SEQ ID NO: 12321

SEQ ID NO: 13207 - RNA, 60 nt, Human
ugaucagguugugugauauuuuugcuugauagagaaucaaauuugaaacaauuaaccagc

SEQ ID NO: 13208 - RNA, 62 nt, Human
auacuuccugggaugaugugugaaaccugacaccuagauuuauuuggaaauauucuaugacc

SEQ ID NO: 13209 - RNA, 62 nt, Human
acagagcaagacucugucucaaaaaaaaaaaaaaauuuaguaaaaaucaaugguaagcuaaa

SEQ ID NO: 13210 - RNA, 62 nt, Human
uuuuuaauguuucacauguuacauuauuagcugaauacguuagaaaaugacagaugguagag

SEQ ID NO: 13211 - RNA, 59 nt, Human
uuacuuucuagguauuuuauggccagauugcuuauaugaguggucuuuugguuugguag

SEQ ID NO: 13212 - RNA, 62 nt, Human
gugcaguggugugaucucggcucacugcaaccuccaccuucagggugucaggccucugggcc

SEQ ID NO: 13213 - RNA, 55 nt, Human
cagcagcccacagcuguggggcuucagcagccacaccagcccagcccagcccagc

SEQ ID NO: 13214 - RNA, 62 nt, Human; identical to SEQ ID NO: 13212

SEQ ID NO: 13215 - RNA, 55 nt, Human; identical to SEQ ID NO: 13213

SEQ ID NO: 13216 - RNA, 62 nt, Human
uugugaugaacacaaauguacuuguguagagacauuuccuuaagagaaagccuaggagaagc

SEQ ID NO: 13217 - RNA, 61 nt, Human
ccuuucaaaguaguggcuuucuggaugguaauuccaucuuaaggugucagaacuauuuuca

SEQ ID NO: 13218 - RNA, 62 nt, Human; identical to SEQ ID NO: 11200

SEQ ID NO: 13219 - RNA, 61 nt, Human
ugagaguugucccuuagccuuauaaacuccccaugaucugacaugcagaaauccagccuug

SEQ ID NO: 13220 - RNA, 62 nt, Human
caugacuaaacugcaaaaaaaaaaaaagagcuacuguauuuagacuuaggaaaaaaggcaga

SEQ ID NO: 13221 - RNA, 59 nt, Human
aauuuuaaaagaaaaugugacuucaaaggaaaggaacaaauuuucaaagacuuggggga

SEQ ID NO: 13222 - RNA, 62 nt, Human
uaugugggaagaaguucagaggaaccguuggaaacgacguuaggcauuuuaccuuuucagua

SEQ ID NO: 13223 - RNA, 62 nt, Human; identical to SEQ ID NO: 10515

SEQ ID NO: 13224 - RNA, 62 nt, Human; identical to SEQ ID NO: 11713

SEQ ID NO: 13225 - RNA, 62 nt, Human; identical to SEQ ID NO: 11714

SEQ ID NO: 13226 - RNA, 62 nt, Human
gacacucuggcugcucccugacagcaccugaagugaccuggaaucagugaagccaaagggac

SEQ ID NO: 13227 - RNA, 61 nt, Human
cccagaguuuucuuuggagaacagaaagaagaaaggaaagaaaggaaccagaggcagagag

SEQ ID NO: 13228 - RNA, 62 nt, Human
aggcgggaguguuucacuuucuggugauaaacuugauggucauuguuaugauuaagauaaug

SEQ ID NO: 13229 - RNA, 60 nt, Human
auuuuuuaaagcacaaaauuggugccaagacugggugagaaauguacauuacccccuuau

SEQ ID NO: 13230 - RNA, 62 nt, Human
cuuuccugcugcagaucugggcugcgguggccagggccgugagucccguggcagagccuucu

SEQ ID NO: 13231 - RNA, 60 nt, Human
uccacuuguugcaguccaaguccucuagugcaacgccauagcaaauauaaagauuuacua

SEQ ID NO: 13232 - RNA, 62 nt, Human; identical to SEQ ID NO: 9845

SEQ ID NO: 13233 - RNA, 62 nt, Human
ggaugcguggaagguuuugguguuuauaacucaugacccaaauccuuccaagacacaaauga

SEQ ID NO: 13234 - RNA, 62 nt, Human
gauguaaaaacccugucuuuuugcacgauacagccaaaaguauuggcugauuucuugcugag

SEQ ID NO: 13235 - RNA, 57 nt, Human
aggaaggauguucaaacggucccacccaagccugucaccucugcucauccuccaaga

SEQ ID NO: 13236 - RNA, 62 nt, Human
acuuucagcgacagcuauggacagcaugguaccaaggaguuaaguugaggcuuuuuccagcu

SEQ ID NO: 13237 - RNA, 62 nt, Human
guacuauaacaaaaacuuaacuuaauguuucucucgagcguaauaaucaggaaagauuuuuu

SEQ ID NO: 13238 - RNA, 62 nt, Human
uaggaauacugucuacaugcuuucucauucaagaauucgucaucacgcaucacaggccgcgu

SEQ ID NO: 13239 - RNA, 62 nt, Human; identical to SEQ ID NO: 12496

SEQ ID NO: 13240 - RNA, 62 nt, Human
aguaguauaugguguuccuagaaugcagcugaagaccuguuauguagaggaaauacgagggg

SEQ ID NO: 13241 - RNA, 62 nt, Human
aaaaaaaauaaaauaaaaauggcuuucccaguccuugcaucaacgggaugccacauuucaua

SEQ ID NO: 13242 - RNA, 62 nt, Human
ggaggagggaaccuggcgggggugucugaggccgcacugucagcuggccgguccaagccugu

SEQ ID NO: 13243 - RNA, 57 nt, Human
uuuugcaaauugcauucugaugcuugugaugaacacaaauguacuuguguagagaca

SEQ ID NO: 13244 - RNA, 62 nt, Human
cucuggacccaggacauuuugaugagauccaaaggaguuguaugcacaugaaaguuugagaa

SEQ ID NO: 13245 - RNA, 53 nt, Human
aucucuacacaggccuguuuuaacaauuacguaaauaauacuuguuuuuuuaa

SEQ ID NO: 13246 - RNA, 62 nt, Human
caaucagugcacauccugugucaucaauguaaaaaucuguuaaaaaucugcauuuagguugg

SEQ ID NO: 13247 - RNA, 57 nt, Human
uucagcaccuggaaccuggaucacauaauagaaaagaaacgcaccaucauuccuaca

SEQ ID NO: 13248 - RNA, 62 nt, Human
cguggacacccuacaccuccauauccuauccaaccguacuaaggacgcguuaccaugagagc

SEQ ID NO: 13249 - RNA, 62 nt, Human; identical to SEQ ID NO: 10905

SEQ ID NO: 13250 - RNA, 62 nt, Human
gggacccgaaguugacugggaaucccagacagaaggaggguagccucuguguuugcucagga

SEQ ID NO: 13251 - RNA, 62 nt, Human
uuuuucuaugucaaauguaacguuuauuuuuuuaaacaauaaaauugauuugccaaaauccg

SEQ ID NO: 13252 - RNA, 62 nt, Human
gaaggggcugcugaggucugauggggcccuuccuccgggugaccccacagggccuuuccaag

SEQ ID NO: 13253 - RNA, 60 nt, Human
uuaagugucccuucgccaggaagcugccgcaacguccagaccugggucaaguucccacuc

SEQ ID NO: 13254 - RNA, 62 nt, Human
acagcugugagagccggauccggaguuaccugagggaggugagcuccuaccccuccacggug

SEQ ID NO: 13255 - RNA, 60 nt, Human
uagaauacaacaauaaaauacagccauguaccacauaacaacaucuugguaaacaacaga

SEQ ID NO: 13256 - RNA, 62 nt, Human
uguccagagaaguccuuggaacccugugggaucuagcucguaacuguuuguauuucucuauu

SEQ ID NO: 13257 - RNA, 61 nt, Human
cuuggagacuccuggucugugaagagccgcugacgcccgcaggaaccgggcugggccuugu

SEQ ID NO: 13258 - RNA, 62 nt, Human
ucugccugagacuggggaaguaagcggguaucuucucagugagcauagguuggggacuguga

SEQ ID NO: 13259 - RNA, 60 nt, Human
uccuggucuuuguuugaggccugacgugggcaucauuuuaacaggugccuuuuuuguuuu

SEQ ID NO: 13260 - RNA, 62 nt, Human
agcaggaacccugggcagcggguguucugggaaggcuagugacagcagaugucauccaggaa

SEQ ID NO: 13261 - RNA, 61 nt, Human
ccaggggccacagccacagccugcuggucucgaacuccuuaccucaggugaucugcuugcc

SEQ ID NO: 13262 - RNA, 62 nt, Human
aggaaguggcaggugugcggcccugcccuggccccguagugaguguggggcccaccugugcc

SEQ ID NO: 13263 - RNA, 59 nt, Human
ucacagcaggaggccagcaggccugaggcaacacgggcaaccgcgaaugccucuuuugg

SEQ ID NO: 13264 - RNA, 62 nt, Human
acuucuaacuagaaaucugccaauuuuuuaaaaaaguaaguaccacucaggccaacaagcca

SEQ ID NO: 13265 - RNA, 56 nt, Human
ugagggagagacccuuucugaaagaaguauggccaaaagcacuuuaaugcugcuga

SEQ ID NO: 13266 - RNA, 62 nt, Human; identical to SEQ ID NO: 10426

SEQ ID NO: 13267 - RNA, 61 nt, Human
gggaguuuguggccacuggguauguguggcuaccgcggguaugcgagugccagauauuggc

SEQ ID NO: 13268 - RNA, 62 nt, Human
agacgguucuuuucuagauuuccucuaccuuuuugcucuuaaaacugcuucucugcucugag

SEQ ID NO: 13269 - RNA, 62 nt, Human
gccagucucaccuccuggagaagacauggccagggaaggcgaggaagccaucaucguggaaa

SEQ ID NO: 13270 - RNA, 62 nt, Human
ggggaccaagcacauugguccuaaaggggcugaagagccugaacugcaccuaacgggaaaga

SEQ ID NO: 13271 - RNA, 61 nt, Human
gcgcggggccacacccgugaaccaugcagacggccgaagaagucuuaggcagggcgcccug

SEQ ID NO: 13272 - RNA, 62 nt, Human
gcugcccugacacccccugagcccccaucugcugaacccugacugguaaacaacugcuguca

SEQ ID NO: 13273 - RNA, 62 nt, Human; identical to SEQ ID NO: 9960

SEQ ID NO: 13274 - RNA, 62 nt, Human; identical to SEQ ID NO: 13272

SEQ ID NO: 13275 - RNA, 62 nt, Human; identical to SEQ ID NO: 9960

SEQ ID NO: 13276 - RNA, 62 nt, Human; identical to SEQ ID NO: 13272

SEQ ID NO: 13277 - RNA, 62 nt, Human; identical to SEQ ID NO: 9960

SEQ ID NO: 13278 - RNA, 62 nt, Human; identical to SEQ ID NO: 13272

SEQ ID NO: 13279 - RNA, 62 nt, Human; identical to SEQ ID NO: 9960

SEQ ID NO: 13280 - RNA, 62 nt, Human; identical to SEQ ID NO: 13272

SEQ ID NO: 13281 - RNA, 62 nt, Human; identical to SEQ ID NO: 9960

SEQ ID NO: 13282 - RNA, 62 nt, Human
gacgaucacuuagagaaacaggccguuaggaauccauucucacuguguucgcucuaaacaaa

SEQ ID NO: 13283 - RNA, 58 nt, Human
accccagcggagaaaacagcauuauauacaucggaguaucauuuuaggauucaagugu

SEQ ID NO: 13284 - RNA, 62 nt, Human
aagagaaugucccugaccgaaaucggccagaagccccucucagguuuauucccaaaauaaac

SEQ ID NO: 13285 - RNA, 56 nt, Human
ugguauaaauggacugucugcugauggccauacgcagcacuggcuguuaagauggg

SEQ ID NO: 13286 - RNA, 62 nt, Human
ccagagaauuuuuacgcaagaagagccaaauugacucucuaaaucugguguauggguauuaa

SEQ ID NO: 13287 - RNA, 60 nt, Human
guaugugaggucagagggcaugagggucacaggucagcaaggugugaggagcacaagcca

SEQ ID NO: 13288 - RNA, 62 nt, Human
aauacuuaaggcacuauggcacuuagcuuugaagugacacgacccugucuuccuuccgcccg

SEQ ID NO: 13289 - RNA, 62 nt, Human
agggacggcccccacggcccagcagacaugcgagcuuccagagugcaaucuaugugaugucu

SEQ ID NO: 13290 - RNA, 62 nt, Human
ccaugacuguguagcaggaauguuuuaauuugugcuuccuuaguaaauugaaauaucagcug

SEQ ID NO: 13291 - RNA, 62 nt, Human
ucugcuccuaggccuccccagcgagcuccucccagaccaagacuuuuguucuguuuuucuac

SEQ ID NO: 13292 - RNA, 62 nt, Human
gcuguggacuccagcauguuucugauaauuaugcaagcaacaauucuguagccucaaguaag

SEQ ID NO: 13293 - RNA, 62 nt, Human; identical to SEQ ID NO: 12128

SEQ ID NO: 13294 - RNA, 62 nt, Human
uuuagauaucuuuauuccauuuauuaugguacaaauaacugauguuuuaaccagaguaauga

SEQ ID NO: 13295 - RNA, 61 nt, Human
gggccccggagaacccugucccugcguguggccacuccucagcauccuccccacccaccau

SEQ ID NO: 13296 - RNA, 62 nt, Human
ggacauugucuugauaaugguuuuccugaucuugccgcaucacuuaaugugauccccauacu

SEQ ID NO: 13297 - RNA, 62 nt, Human
ugucccuaacaguccacaggcaaacaaaugguacagucauaagagccaucugucacggaccc

SEQ ID NO: 13298 - RNA, 62 nt, Human; identical to SEQ ID NO: 9500

SEQ ID NO: 13299 - RNA, 62 nt, Human; identical to SEQ ID NO: 9501

SEQ ID NO: 13300 - RNA, 62 nt, Human; identical to SEQ ID NO: 9500

SEQ ID NO: 13301 - RNA, 62 nt, Human; identical to SEQ ID NO: 9501

SEQ ID NO: 13302 - RNA, 62 nt, Human; identical to SEQ ID NO: 9500

SEQ ID NO: 13303 - RNA, 62 nt, Human; identical to SEQ ID NO: 9501

SEQ ID NO: 13304 - RNA, 62 nt, Human; identical to SEQ ID NO: 9500

SEQ ID NO: 13305 - RNA, 62 nt, Human; identical to SEQ ID NO: 9501

SEQ ID NO: 13306 - RNA, 62 nt, Human; identical to SEQ ID NO: 9500

SEQ ID NO: 13307 - RNA, 62 nt, Human; identical to SEQ ID NO: 9501

SEQ ID NO: 13308 - RNA, 62 nt, Human; identical to SEQ ID NO: 9500

SEQ ID NO: 13309 - RNA, 62 nt, Human; identical to SEQ ID NO: 9501

SEQ ID NO: 13310 - RNA, 62 nt, Human
ucccaucacgcagacaggaaggguguuugcgcacucugaucaacuggaaccucuguaucaug

SEQ ID NO: 13311 - RNA, 59 nt, Human
aggacuguauauaauuguaauaaauaccaguugccacuauuuaauuucugccuguggcu

SEQ ID NO: 13312 - RNA, 62 nt, Human
acuaguuaauuuugaguaauuguauugucagaaaagugauuaguacuauuuuuuuuuguugu

SEQ ID NO: 13313 - RNA, 60 nt, Human
ucaccuggggaccuggcagggcacaucuccgcugugccuacugcaaggcggucccacugc

SEQ ID NO: 13314 - RNA, 62 nt, Human; identical to SEQ ID NO: 12964

SEQ ID NO: 13315 - RNA, 61 nt, Human
cauagacuggauuaaagaaguuuuccaguuccaaaaauuaaaggaauauauccuuaugaug

SEQ ID NO: 13316 - RNA, 62 nt, Human
uccccaugagcgucugcaaaacacuugccugaauacauaucacguauuuuagacucgaagcc

SEQ ID NO: 13317 - RNA, 61 nt, Human
ugucccaccgguggaugcagaggggaauccgaggccaucaaccuuggugacagcagcgcag

SEQ ID NO: 13318 - RNA, 62 nt, Human
ggaagccuaucagcgaguggcuaaugagcaggagauuuaugaagguuccagacaguuggcug

SEQ ID NO: 13319 - RNA, 58 nt, Human
aacacauuagcacauacuguccauuagcauaucugggauaaccagguuuuggggguug

SEQ ID NO: 13320 - RNA, 62 nt, Human
auuggggccagcuugauguuuuaaaucuucagcccgguaugaaaacuuaaagguauauauuc

SEQ ID NO: 13321 - RNA, 60 nt, Human
aacagaccauggaaauuuaaacgacuuccucacggucacagaacuaguuuuuuaauccuc

SEQ ID NO: 13322 - RNA, 62 nt, Human
gaaggagcggcuggagcccagguuucaggcacccguggaugagcagucagagagucuacaga

SEQ ID NO: 13323 - RNA, 57 nt, Human
agcagagcaggcaggggugggggccgggccugcaagagcccgaaaggucgccacccc

SEQ ID NO: 13324 - RNA, 62 nt, Human; identical to SEQ ID NO: 9266

SEQ ID NO: 13325 - RNA, 62 nt, Human
guaagcgccugggagagccuagaccaggcuccgggcugccaauaaagaagugaaaugcguau

SEQ ID NO: 13326 - RNA, 62 nt, Human
acuuuuguuauaagcuauuuaaaaccaguaaggagacuugaaauucagaaaaucaacacauu

SEQ ID NO: 13327 - RNA, 62 nt, Human
caucuuucucuacuguaaagugauuuuguuugcagguaagaaaauaauagaugacucaccac

SEQ ID NO: 13328 - RNA, 62 nt, Human
ucagguugaagaugcuuucagugaugcucucuauacucauaaauaagcaaauguggcaggcu

SEQ ID NO: 13329 - RNA, 62 nt, Human
ugaagggcaggccggcccuugaugugccauuucugaauaauagucacugccgccgagucuag

SEQ ID NO: 13330 - RNA, 62 nt, Human; identical to SEQ ID NO: 9961

SEQ ID NO: 13331 - RNA, 61 nt, Human
gcacaccccuuagcgcuugccuagguugcugaaaacagggaggcaccugguaucucgagug

SEQ ID NO: 13332 - RNA, 62 nt, Human
uguaucuuuauuucagaugucacccagaguaaauuauaauuagaaguauagcuagaaugagc

SEQ ID NO: 13333 - RNA, 62 nt, Human; identical to SEQ ID NO: 12838

SEQ ID NO: 13334 - RNA, 62 nt, Human
aagccuaggagaagccgauuuggagguuaaugcuguagaauaggacuguauaccaaauguaa

SEQ ID NO: 13335 - RNA, 60 nt, Human
aguuaucgcuacucuguuucauagaaauccccauccaucaagaaauaugaaaguuaaggc

SEQ ID NO: 13336 - RNA, 62 nt, Human
ucgccgguggcucauuuucuggcaaauggaggcacgaacgcaggggccaaauagcaauaaau

SEQ ID NO: 13337 - RNA, 60 nt, Human
ccugcuggaaagauagcaguguucuccugacuucgcccuacugcaugcagccaaauaaaa

SEQ ID NO: 13338 - RNA, 62 nt, Human; identical to SEQ ID NO: 9524

SEQ ID NO: 13339 - RNA, 62 nt, Human
agcugacuucagcagcccacagcuguggggcuucagcagccacaccagcccagcccagccca

SEQ ID NO: 13340 - RNA, 62 nt, Human
ucucuacaaaaaauacaaaaauuaaccaagcgugguagugcacgccuguauucccagcuacu

SEQ ID NO: 13341 - RNA, 60 nt, Human
cacggcuccgagggcggccagggacagacgcuugcgccgagaccgcagagggaagcguca

SEQ ID NO: 13342 - RNA, 62 nt, Human
ugaagauccccaagggggagguucgguagagaaaaauaguaagcugguuuagaaacugacga

SEQ ID NO: 13343 - RNA, 62 nt, Human
auguagccuuuuuuaguaaccuuggaagcuguaguaauucuaaggaaucaugaaccuugccu

SEQ ID NO: 13344 - RNA, 62 nt, Human; identical to SEQ ID NO: 9997

SEQ ID NO: 13345 - RNA, 62 nt, Human
agaaagaacauuauuguucuuuaauuccuacaagguacucgaaaaccuuaagugaaaaagau

SEQ ID NO: 13346 - RNA, 62 nt, Human; identical to SEQ ID NO: 12554

SEQ ID NO: 13347 - RNA, 62 nt, Human; identical to SEQ ID NO: 9455

SEQ ID NO: 13348 - RNA, 62 nt, Human
cuucaugacauucggccucauccauaggguccugaagcugcaguccacagcucagaaaggag

SEQ ID NO: 13349 - RNA, 60 nt, Human
gaaagagcauaguuuaacaucuugagaaauuugggacauaaaguuuucaugguagacagu

SEQ ID NO: 13350 - RNA, 62 nt, Human; identical to SEQ ID NO: 9757

SEQ ID NO: 13351 - RNA, 62 nt, Human; identical to SEQ ID NO: 10603

SEQ ID NO: 13352 - RNA, 62 nt, Human
uguccuuggucuucugaagauucagguccuccucuccggguagcuuagaaguaaggagguug

SEQ ID NO: 13353 - RNA, 60 nt, Human
ugcuggucaagccagggcagucacagcugcuuggggcccacagcacugcugccuggucuc

SEQ ID NO: 13354 - RNA, 62 nt, Human
cgggauacgggaagccaccugugucagggcuaggcccugggaucgggaguuacacuacccug

SEQ ID NO: 13355 - RNA, 62 nt, Human; identical to SEQ ID NO: 10357

SEQ ID NO: 13356 - RNA, 62 nt, Human
aaggaaucaagggacuuuaagcuagaucaaaaucuggggacaaauucuccugcuaacugcaa

SEQ ID NO: 13357 - RNA, 62 nt, Human; identical to SEQ ID NO: 9284

SEQ ID NO: 13358 - RNA, 62 nt, Human
uuguuuguuuuuaagaaacaagaaaacagaacugccuuugcacuaaauuagugacuuggacu

SEQ ID NO: 13359 - RNA, 50 nt, Human
guucacaauagagcucagggaacccguauaucauaccauuccuuggauga

SEQ ID NO: 13360 - RNA, 62 nt, Human
ugugcauagucuccagagcuucaaaggcaacacaagcucgcaacucuaagauuuuuuuaaac

SEQ ID NO: 13361 - RNA, 62 nt, Human
ugccugcccucgugugacauggaauuggugucaggaccgccacguggccuucagaggaaucc

SEQ ID NO: 13362 - RNA, 62 nt, Human
ccucagcugcagggaggcagaaggcaaggcaggccccacggacacacuugggcugcucugaa

SEQ ID NO: 13363 - RNA, 61 nt, Human
auuauauggggaagucgagggccuguggcuuggauccgccaugcagagauguggccgggca

SEQ ID NO: 13364 - RNA, 62 nt, Human
auuccuacacugguggaagcaauuaaggaacaagauggaagagaaguggacugggaguauuu

SEQ ID NO: 13365 - RNA, 62 nt, Human
aguccuggccgggccaaggccugggaaacugugaaagucagaaaggccagcggggagaggcu

SEQ ID NO: 13366 - RNA, 62 nt, Human
ccaauguggguguaaauuuuuaaaaaaugauuauugauagaaguuuggcaggaaaauucuuu

SEQ ID NO: 13367 - RNA, 54 nt, Human
ugaaacuguaguucccuuuggaagcccagucauaggaugggaaagugggcaugg

SEQ ID NO: 13368 - RNA, 62 nt, Human; identical to SEQ ID NO: 11771

SEQ ID NO: 13369 - RNA, 62 nt, Human; identical to SEQ ID NO: 11772

SEQ ID NO: 13370 - RNA, 62 nt, Human
cugcagacaaugcuuuagcccuacucuugggcccccaaguuagcagaguaaucaaagcuucc

SEQ ID NO: 13371 - RNA, 62 nt, Human; identical to SEQ ID NO: 12215

SEQ ID NO: 13372 - RNA, 62 nt, Human
cucaccacgccuguacugcagacacggucguguagaguagcagcugauuugaccugucccag

SEQ ID NO: 13373 - RNA, 62 nt, Human; identical to SEQ ID NO: 11867

SEQ ID NO: 13374 - RNA, 62 nt, Human
uuuaucugucuuggucaccccggccaggccccggaagcagcagccagggaugguccuuccuc

SEQ ID NO: 13375 - RNA, 62 nt, Human; identical to SEQ ID NO: 11867

SEQ ID NO: 13376 - RNA, 62 nt, Human
ugcccuccgcugcuccucagaccccagcccccagcgagccgacguccccacccguuccugcu

SEQ ID NO: 13377 - RNA, 59 nt, Human
uucuuguauuuguacuaauucugauucuuuugcuguauagccuuagaugugcaaugcag

SEQ ID NO: 13378 - RNA, 61 nt, Human; identical to SEQ ID NO: 9252

SEQ ID NO: 13379 - RNA, 60 nt, Human
cucagaagagguggcuuuggcccagaggcucaggccgggacugagauggacagacccagg

SEQ ID NO: 13380 - RNA, 62 nt, Human
aauauaaucugauaauuaaugguuuguggaauccauuaugaagugcaauuagauagauguag

SEQ ID NO: 13381 - RNA, 57 nt, Human
acaacaacauuuuuucaacaauuucaacaaugacacaaaaauucacauggaaauggg

SEQ ID NO: 13382 - RNA, 62 nt, Human; identical to SEQ ID NO: 10656

SEQ ID NO: 13383 - RNA, 62 nt, Human; identical to SEQ ID NO: 10659

SEQ ID NO: 13384 - RNA, 62 nt, Human; identical to SEQ ID NO: 12939

SEQ ID NO: 13385 - RNA, 57 nt, Human
ggcugcgcugaagugugaccugaccguguggaaccaaacccuuccagcgucucugcu

SEQ ID NO: 13386 - RNA, 62 nt, Human
ccacaugugucuucucacucuacaccagccaugcccgcggcagcacccgugccgggcagccu

SEQ ID NO: 13387 - RNA, 62 nt, Human
gcagcgcggugugaaacugggauaaaaacggggcuuggccgaaggacuuuuaucugucuugg

SEQ ID NO: 13388 - RNA, 62 nt, Human
ugccauuuagugaaagugcuugaauugaugcccuucgauguaaguucaaccauuuuugcucu

SEQ ID NO: 13389 - RNA, 62 nt, Human
gggcaggaagcagccuuugaaaaaucaaauccuagcgcacaacacugauaacccuucacaug

SEQ ID NO: 13390 - RNA, 62 nt, Human; identical to SEQ ID NO: 11773

SEQ ID NO: 13391 - RNA, 60 nt, Human; identical to SEQ ID NO: 12938

SEQ ID NO: 13392 - RNA, 62 nt, Human
gauugcucacugaaagacucagcacccccaauggugcgcggaagccaggcgggcgauuacaa

SEQ ID NO: 13393 - RNA, 60 nt, Human
gcuuugaucagguuucccuggguguucagagcccgaacaaagagggucucuaagcacagg

SEQ ID NO: 13394 - RNA, 62 nt, Human
cacaugggaagagaagguacagaggcaaggaggaugccggcaaggccuucgccagcuagaag

SEQ ID NO: 13395 - RNA, 59 nt, Human
uccgggccaccaagccgcaccugugccugagacuccggauggacgacacagucgucacg

SEQ ID NO: 13396 - RNA, 62 nt, Human
gaugaagaacaggcauugcaaggacccucugaugggacgguacugagauaucucggcuuccg

SEQ ID NO: 13397 - RNA, 62 nt, Human
aucgaggccuguugcucauuaagcugagugcagacguccuuaaucccugcagauagugggau

SEQ ID NO: 13398 - RNA, 62 nt, Human; identical to SEQ ID NO: 12511

SEQ ID NO: 13399 - RNA, 60 nt, Human
aaauacaaaaaaauuagccaggcauaguggcgcgcgccuauaaucccagcuacugggagg

SEQ ID NO: 13400 - RNA, 62 nt, Human
gcaccgagaccucaccaagcaccacucgcucaucaaggcggagaucaugggagacguccugc

SEQ ID NO: 13401 - RNA, 60 nt, Human
ggcagcuucggggcaaggaugguucugcugucuccgcguaacaccuguguguccuaucug

SEQ ID NO: 13402 - RNA, 62 nt, Human; identical to SEQ ID NO: 12169

SEQ ID NO: 13403 - RNA, 62 nt, Human
ucuccagagucaaaagggaagucgagggauggggcgucgucagcuggcacugucucugcugc

SEQ ID NO: 13404 - RNA, 62 nt, Human; identical to SEQ ID NO: 10152

SEQ ID NO: 13405 - RNA, 58 nt, Human
gcgagaaaaauguggauguacuguuuguauauauuguauauauuaaaacagagauaug

SEQ ID NO: 13406 - RNA, 62 nt, Human
guucaggcaauucucgugccuaagccucccgaguagcugcgacuacaggcgccggccagcau

SEQ ID NO: 13407 - RNA, 60 nt, Human
ugggauuugcuauugaaucucuacccucucccaccacacaguacugauugcucacugaaa

SEQ ID NO: 13408 - RNA, 62 nt, Human
aggcaccugagagaggaacucuguggggugggggccguugcagguguacugggcugucaggg

SEQ ID NO: 13409 - RNA, 61 nt, Human
caggacacucaaccccaggaggggagccgcucggcgaaugagcugggugggugcccaggag

SEQ ID NO: 13410 - RNA, 62 nt, Human
uguggauguacuguuuguauauauuguauauauuaaaacagagauaugugcaugaaaucaag

SEQ ID NO: 13411 - RNA, 59 nt, Human
ugacacuucauuguaauucacaguguaaauuuaauccaaacugaaauuuuguuucaacu

SEQ ID NO: 13412 - RNA, 62 nt, Human
uguuagugaugcacauguguaacagcccccucuaaaagcgcaagccagucauaccccuguau

SEQ ID NO: 13413 - RNA, 58 nt, Human
gcaaucagcuucuuuauaugcaaauuaggcacgacccaucugugguuccugguuggug

SEQ ID NO: 13414 - RNA, 62 nt, Human
aaggaaaaaugagacacagggcuaacugaagauacgguuggaaagcuugcaucuuugugaag

SEQ ID NO: 13415 - RNA, 54 nt, Human
uguggccacuggguauguguggcuaccgcggguaugcgagugccagauauuggc

SEQ ID NO: 13416 - RNA, 62 nt, Human; identical to SEQ ID NO: 13270

SEQ ID NO: 13417 - RNA, 62 nt, Human
gauccucugccgcccagaccucaacagcacagagcacuuccaggccuccauucaggacuaca

SEQ ID NO: 13418 - RNA, 62 nt, Human
ugagcccgggaaguggagguugcacugagcugagaccauggaauugcacugcagcaugggca

SEQ ID NO: 13419 - RNA, 61 nt, Human
ugggcuugauuccaccuggugggguggguggacccuggagacucucaggugaugggccagc

SEQ ID NO: 13420 - RNA, 62 nt, Human
gagucccaggugucaucuuccugcucugcgacuuucucuggagaccuugggccuuuggccug

SEQ ID NO: 13421 - RNA, 59 nt, Human
uccugaggugccucccaguggccuggcuugucggagcaaguuucaucagcccuagggaa

SEQ ID NO: 13422 - RNA, 62 nt, Human
guguucugcccuggcaguaauugcacaucaguugucauuggaguuugugaguuggcugucuc

SEQ ID NO: 13423 - RNA, 61 nt, Human
ugagcgagaaaaauguggauguacuguuuguauauauuguauauauuaaaacagagauaug

SEQ ID NO: 13424 - RNA, 62 nt, Human
uuauggcuggaccggcccugcaggaggugguggagccgugaaggaggccgagcugcagcucu

SEQ ID NO: 13425 - RNA, 55 nt, Human
agugcugggauuacaggcgugagccaccgcgcccagccagaacaucuguuuuuac

SEQ ID NO: 13426 - RNA, 62 nt, Human
ucauuuauuucaugauucaaccugauacauuuacauagugcaaaacugugucacaguuucag

SEQ ID NO: 13427 - RNA, 61 nt, Human
aauggucacuuuaccacagcuaaaaaugaguuacgauagcagcuugauggugauuguauug

SEQ ID NO: 13428 - RNA, 62 nt, Human
cuuuccagauaagcccaaagacagcaacuucuccacucaugacaaaucaacugugacccucg

SEQ ID NO: 13429 - RNA, 61 nt, Human
agggaggagguggcagcccuguagggaacgggguccuucaaguuagcucaggaggcuugga

SEQ ID NO: 13430 - RNA, 62 nt, Human
gguuuuacaagugacgguuuccccggcucccuccugccgccaugugaagaaggucguugcuu

SEQ ID NO: 13431 - RNA, 62 nt, Human
uuuagguucuaagguuuuaucuuguugcaagagugggaccuacccaagggggaagacaagau

SEQ ID NO: 13432 - RNA, 62 nt, Human; identical to SEQ ID NO: 12754

SEQ ID NO: 13433 - RNA, 60 nt, Human
ccagcugcagagcauauuguggauuggaaaggcugcgacagccccccaaacaggaaagac

SEQ ID NO: 13434 - RNA, 62 nt, Human
ucuuggcgagacacagcuugagaacagaagggcgucgggggaaccugccgcaaggagcagag

SEQ ID NO: 13435 - RNA, 60 nt, Human
ugaaagaagcacccagggccucaaauuucaucuccauacaagacaggaagcuaguuuauc

SEQ ID NO: 13436 - RNA, 62 nt, Human
gccccucccuagagccucugagguuugagagagagagcgggaggagggucuggcuuggggac

SEQ ID NO: 13437 - RNA, 56 nt, Human
uuccuucccuccucugucccugccucggccaccccacgcgggaacccagcgccguc

SEQ ID NO: 13438 - RNA, 62 nt, Human; identical to SEQ ID NO: 9917

SEQ ID NO: 13439 - RNA, 62 nt, Human; identical to SEQ ID NO: 10201

SEQ ID NO: 13440 - RNA, 62 nt, Human
gcagcggcaccccucgguuauuaaggagggaggaguaggggauagaaguauuucaaaauagu

SEQ ID NO: 13441 - RNA, 60 nt, Human
cugugaacagguauuuucaggacucaaacuaccacaaugaacagaguauagauuuuagau

SEQ ID NO: 13442 - RNA, 62 nt, Human; identical to SEQ ID NO: 11493

SEQ ID NO: 13443 - RNA, 60 nt, Human
agcugaugauuugaaaccaacguucacccaacuugucagaaauggcacuuacaugguucg

SEQ ID NO: 13444 - RNA, 62 nt, Human
gcugacuggccgaagucuuuuuuaccuccugggggcagggcagacgccgugugucuguuuca

SEQ ID NO: 13445 - RNA, 62 nt, Human; identical to SEQ ID NO: 12571

SEQ ID NO: 13446 - RNA, 62 nt, Human
ccaggaugcucagcuggccaggagggcagcaccugcuggggacgguggcccugccuucaugc

SEQ ID NO: 13447 - RNA, 60 nt, Human
ccagugaaugguggacugaguggugcgagguggagggcuaacaagaggaaagaacuacau

SEQ ID NO: 13448 - RNA, 62 nt, Human; identical to SEQ ID NO: 13446

SEQ ID NO: 13449 - RNA, 60 nt, Human
aggaugcucagcuggccaggagggcagcaccugcuggggacgguggcccugccuucaugc

SEQ ID NO: 13450 - RNA, 62 nt, Human
ugguucaugccuauaaucccagcgcuuugggaggucgaggcaggcagaucaccugaggucag

SEQ ID NO: 13451 - RNA, 54 nt, Human
ccucccuguccaagaagugacuguugagaggcgaggagguagugggugaggcua

SEQ ID NO: 13452 - RNA, 62 nt, Human; identical to SEQ ID NO: 9320

SEQ ID NO: 13453 - RNA, 62 nt, Human; identical to SEQ ID NO: 9321

SEQ ID NO: 13454 - RNA, 62 nt, Human
aggauuauauuuguaaucaaaaaaaaaaaaucacuuggcgcaggagggagaacuuuguaaga

SEQ ID NO: 13455 - RNA, 62 nt, Human
ugacuguuuacaagcgauaguguaagaaagaauccguccgcaaaaguuuugaccuugcaacc

SEQ ID NO: 13456 - RNA, 62 nt, Human
uuagaaauaaagcaucucauaaauuugagacaaauagucggacauccaggucacggggcacc

SEQ ID NO: 13457 - RNA, 57 nt, Human
guggggcacuggggaugguaaccucacugccccgucacucccuucaaaggcgacaga

SEQ ID NO: 13458 - RNA, 62 nt, Human; identical to SEQ ID NO: 13237

SEQ ID NO: 13459 - RNA, 60 nt, Human
cagcucaguggguguggggaucacaugagguggcucaugaggacacacucuggaagucga

SEQ ID NO: 13460 - RNA, 62 nt, Human
accucugggcccggccccuccgcugacggcaucgcggccggauucagucacucugccgaagg

SEQ ID NO: 13461 - RNA, 61 nt, Human
ggcugaggaugucccuugcuccugggcaaaaucccgauggacucugcgguuucagcuccac

SEQ ID NO: 13462 - RNA, 62 nt, Human
accccagcgcucagccguucuuauuucuuuuuccuuaucguagaauuaagauagggagagcc

SEQ ID NO: 13463 - RNA, 52 nt, Human
gggcggcauacgccaugugagcacaggacucaggccacccucgcuuguccug

SEQ ID NO: 13464 - RNA, 62 nt, Human
auauugcagacugaacagacguuuaucuaucccauuuggcgacgaggacucguggcuggaga

SEQ ID NO: 13465 - RNA, 56 nt, Human
agagcuugcuauuuguacaucuguugagcaacacuacauaacugauuuuuaguuga

SEQ ID NO: 13466 - RNA, 62 nt, Human
auggauucaucaccugucaugcauugacaccugauacccagacuuaauugguauuuguucuu

SEQ ID NO: 13467 - RNA, 50 nt, Human
ccuucagcaauguugugugaaauauacuaaacaucaaagaaucuauguug

SEQ ID NO: 13468 - RNA, 62 nt, Human; identical to SEQ ID NO: 13466

SEQ ID NO: 13469 - RNA, 60 nt, Human
uccguagcuaucaggaucauugcgcacucauauaugcuaagccuucuguucucuaauaga

SEQ ID NO: 13470 - RNA, 62 nt, Human; identical to SEQ ID NO: 9532

SEQ ID NO: 13471 - RNA, 59 nt, Human
ugggagaccaccccuugccacuugggccacuuccgccuaccccacuuuucauuuuguuc

SEQ ID NO: 13472 - RNA, 62 nt, Human
aaugugcuuauuucuuugccuuagcacacguuuuauggaguacuuguuauacuagguuugau

SEQ ID NO: 13473 - RNA, 62 nt, Human
ugaguuugaguuuggacagcuucaaagagugguccguucaaaugucaaagcaaggugccuuu

SEQ ID NO: 13474 - RNA, 62 nt, Human; identical to SEQ ID NO: 10152

SEQ ID NO: 13475 - RNA, 60 nt, Human
aaagaagagaaaaaaaaugcccaaguugcccuuuaaaaaaaaagagcguaaauacaaaca

SEQ ID NO: 13476 - RNA, 62 nt, Human
agagguuuuauuuuuuggccuuagaaucugcagaaauuaggaggcaccgagcccagcgcagc

SEQ ID NO: 13477 - RNA, 53 nt, Human
guauuuuucaaagauaaagaaaguguacugcgaaaauaugcaggaagauuaau

SEQ ID NO: 13478 - RNA, 62 nt, Human; identical to SEQ ID NO: 12865

SEQ ID NO: 13479 - RNA, 55 nt, Human; identical to SEQ ID NO: 12103

SEQ ID NO: 13480 - RNA, 62 nt, Human; identical to SEQ ID NO: 11917

SEQ ID NO: 13481 - RNA, 61 nt, Human
ccccuuauuauuuugacgguuuuuuuuuucggggcaggggaccuuaccuguaagacuuuua

SEQ ID NO: 13482 - RNA, 62 nt, Human
gcagcgcuuuccuugcagaagccagagaaggcccacccgcgagccugaucagggaggaugug

SEQ ID NO: 13483 - RNA, 62 nt, Human
ugcuuucugccuugguggcaggcagagaacugucucguacuagaauucaaggaggaaagaag

SEQ ID NO: 13484 - RNA, 62 nt, Human; identical to SEQ ID NO: 12261

SEQ ID NO: 13485 - RNA, 62 nt, Human; identical to SEQ ID NO: 11689

SEQ ID NO: 13486 - RNA, 62 nt, Human; identical to SEQ ID NO: 10687

SEQ ID NO: 13487 - RNA, 62 nt, Human
acuacuccaaacaaaacacaauaugccuaggggcacggaugaacguccagggagcccgggcc

SEQ ID NO: 13488 - RNA, 62 nt, Human
cuguugaguccugucuccugggucugacuuuccguaauaugauugggguacaguagagguga

SEQ ID NO: 13489 - RNA, 62 nt, Human
caaaaacaaaaguaaacuccuuucccuggcccuccaaacauauauucugugagauaacugug

SEQ ID NO: 13490 - RNA, 62 nt, Human; identical to SEQ ID NO: 10586

SEQ ID NO: 13491 - RNA, 62 nt, Human; identical to SEQ ID NO: 10587

SEQ ID NO: 13492 - RNA, 59 nt, Human
cucuguuccugccacauugaggaagggggcugggcacgacauggcaucauacucaggag

SEQ ID NO: 13493 - RNA, 60 nt, Human
aggcugcagucugguucccaguggggcugccucaguccuacccccagcacccucaaaagc

SEQ ID NO: 13494 - RNA, 62 nt, Human
accugagauaaugagaaaaguuuauugcucuaaacggcgcuaaaguguggcuacaguaaaag

SEQ ID NO: 13495 - RNA, 62 nt, Human
uccccgcugugccaggugggcaggcaggagcaaggccugcgagggaggaacgggccgcuccc

SEQ ID NO: 13496 - RNA, 62 nt, Human; identical to SEQ ID NO: 11158

SEQ ID NO: 13497 - RNA, 59 nt, Human
ucugcauuucccucgugcugugucccgcucggguuccaauggacaguaucagggcuugu

SEQ ID NO: 13498 - RNA, 62 nt, Human; identical to SEQ ID NO: 10758

SEQ ID NO: 13499 - RNA, 60 nt, Human
gccuguagucccagcuacucgggaggcugaugcagaagaauggcgugaacccggaaggca

SEQ ID NO: 13500 - RNA, 62 nt, Human
uucgccucccuccccuccgccagagcugccuguggccagacacacgguggagggaagugcac

SEQ ID NO: 13501 - RNA, 62 nt, Human
agacaaguguucuauuuauuucuuguauuguuuggaagaaaaaaugaugauagagucccaaa

SEQ ID NO: 13502 - RNA, 62 nt, Human
gaaccgccugccugugcacucacgccaccccccagcccacaaagagcccaucugagagaagg

SEQ ID NO: 13503 - RNA, 56 nt, Human; identical to SEQ ID NO: 13086

SEQ ID NO: 13504 - RNA, 62 nt, Human
gcaccuggccgguuauucucucuuuacagauagcuauagacaucauuuuaggaaguguugca

SEQ ID NO: 13505 - RNA, 59 nt, Human
ucaucgggaaaugaucucccaagucgcugccagacaccacccacugcuucgccggacaa

SEQ ID NO: 13506 - RNA, 62 nt, Human
cucuuccuggucuggaagcccuuggguccuaugguggcggcagcucccacaguccagguucc

SEQ ID NO: 13507 - RNA, 60 nt, Human
agaccagcugacugucucucggcccagcccaccacgccgaguagcuuguguggaugcagu

SEQ ID NO: 13508 - RNA, 62 nt, Human; identical to SEQ ID NO: 9434

SEQ ID NO: 13509 - RNA, 62 nt, Human; identical to SEQ ID NO: 12040

SEQ ID NO: 13510 - RNA, 62 nt, Human
gcagucagagagucuacagaacacgcacgacgacagcaggaacaacgcggccucagccaggu

SEQ ID NO: 13511 - RNA, 62 nt, Human
guguguggugucuguugcugugucgugaaacugugaccaucacucaguccaaacaagugagu

SEQ ID NO: 13512 - RNA, 62 nt, Human; identical to SEQ ID NO: 12274

SEQ ID NO: 13513 - RNA, 62 nt, Human
aauguaucgggaaucccaggaggacggcccgacuggggcaaaagcuccagcguucuggacaa

SEQ ID NO: 13514 - RNA, 62 nt, Human
cggcagccgccucugcacaccggaaggcugguucuccugccaggugagcugugugcccuuua

SEQ ID NO: 13515 - RNA, 60 nt, Human
guggacaauugggggucacuggcagagacaguauugcccaaaauguucacagcaggaggc

SEQ ID NO: 13516 - RNA, 62 nt, Human; identical to SEQ ID NO: 11845

SEQ ID NO: 13517 - RNA, 62 nt, Human; identical to SEQ ID NO: 11846

SEQ ID NO: 13518 - RNA, 62 nt, Human
ggccauacgcagcacuggcuguuaagauggggaagggguacaucaggauuccacucauagcc

SEQ ID NO: 13519 - RNA, 62 nt, Human
aagauaggcaaaaaggauugaauccauaccagaacacguagacaggcuguaauauucaaacc

SEQ ID NO: 13520 - RNA, 62 nt, Human; identical to SEQ ID NO: 12725

SEQ ID NO: 13521 - RNA, 62 nt, Human; identical to SEQ ID NO: 12726

SEQ ID NO: 13522 - RNA, 62 nt, Human
cuucagaauuaaaaucauuaccuugugugugaaccuucuacaucuucauaggccuuucuucc

SEQ ID NO: 13523 - RNA, 62 nt, Human
uaaaguuggccucuauccuaaugacucaaaacuugguucuuaacuaccaugauugcuuuuga

SEQ ID NO: 13524 - RNA, 62 nt, Human
ggauuguuacugguugaagugggggcagaugccugucaccaagguguugacugugugagaaa

SEQ ID NO: 13525 - RNA, 62 nt, Human
ucugaaguuacucauuauaagucaagcaaacgagaaguacgaacaucugauucuuccagcca

SEQ ID NO: 13526 - RNA, 62 nt, Human; identical to SEQ ID NO: 11703

SEQ ID NO: 13527 - RNA, 62 nt, Human; identical to SEQ ID NO: 10896

SEQ ID NO: 13528 - RNA, 62 nt, Human; identical to SEQ ID NO: 11703

SEQ ID NO: 13529 - RNA, 62 nt, Human; identical to SEQ ID NO: 10896

SEQ ID NO: 13530 - RNA, 62 nt, Human; identical to SEQ ID NO: 11703

SEQ ID NO: 13531 - RNA, 62 nt, Human; identical to SEQ ID NO: 10896

SEQ ID NO: 13532 - RNA, 62 nt, Human; identical to SEQ ID NO: 11703

SEQ ID NO: 13533 - RNA, 62 nt, Human; identical to SEQ ID NO: 10896

SEQ ID NO: 13534 - RNA, 62 nt, Human; identical to SEQ ID NO: 11703

SEQ ID NO: 13535 - RNA, 62 nt, Human; identical to SEQ ID NO: 10896

SEQ ID NO: 13536 - RNA, 62 nt, Human; identical to SEQ ID NO: 11703

SEQ ID NO: 13537 - RNA, 62 nt, Human; identical to SEQ ID NO: 10896

SEQ ID NO: 13538 - RNA, 62 nt, Human
ccuccccccuucucccccuucccacugugauuggcacaucgacaagggcugucccaagucaa

SEQ ID NO: 13539 - RNA, 59 nt, Human
ggguggggacugggcugugcccagggccucugucccccaggaugucuuguggugcgggu

SEQ ID NO: 13540 - RNA, 62 nt, Human; identical to SEQ ID NO: 11754

SEQ ID NO: 13541 - RNA, 60 nt, Human
acccacgcagccuccaucccgcgugucuugcucuccgcgauggcaaugccgagagugccc

SEQ ID NO: 13542 - RNA, 62 nt, Human; identical to SEQ ID NO: 11006

SEQ ID NO: 13543 - RNA, 60 nt, Human
gggccuuccugaccaacagccagcucuguccuuccccccaggaaacacauguucauuugu

SEQ ID NO: 13544 - RNA, 62 nt, Human; identical to SEQ ID NO: 12223

SEQ ID NO: 13545 - RNA, 57 nt, Human
caaucuugcccacacacugagaaguaacucggagcuacagucuguuaaaaaugaaaa

SEQ ID NO: 13546 - RNA, 62 nt, Human
ccagcucaagcccgcugguggcagggcguuuucccaccgggauacgggaagccaccuguguc

SEQ ID NO: 13547 - RNA, 62 nt, Human
ucucuggagaccuugggccuuuggccuguggggcacuggggaugguaaccucacugccccgu

SEQ ID NO: 13548 - RNA, 62 nt, Human
gcagguggagguugcuagucuaguuuccuuuuugagauacuauuuucauuuuugugagccuc

SEQ ID NO: 13549 - RNA, 55 nt, Human
ucaagacuuuugacuuagaaccugcuauauuaucaagcuuaccuacuguuaucuc

SEQ ID NO: 13550 - RNA, 62 nt, Human; identical to SEQ ID NO: 10206

SEQ ID NO: 13551 - RNA, 62 nt, Human
gaauuacuggacuaauugaauaguuaagguuucuauucgggacaauaaaauguauuuugaaa

SEQ ID NO: 13552 - RNA, 62 nt, Human; identical to SEQ ID NO: 9425

SEQ ID NO: 13553 - RNA, 60 nt, Human
gugugucgugugggaguggggcgauuuuuuaugugccaaauacccccgucccccccauga

SEQ ID NO: 13554 - RNA, 62 nt, Human; identical to SEQ ID NO: 11975

SEQ ID NO: 13555 - RNA, 60 nt, Human
aggagacucgcugggagugggagggcagcacgggcgugaaggucggaggacagagaaagg

SEQ ID NO: 13556 - RNA, 62 nt, Human
uaccuccuaccccaugguggcaccacagaggcccucagccgaguccugccugaguguugcaa

SEQ ID NO: 13557 - RNA, 61 nt, Human; identical to SEQ ID NO: 10020

SEQ ID NO: 13558 - RNA, 62 nt, Human
uccccuccauaauuaagaugaaacauuccgguuuucucacaacacauuagcacauacugucc

SEQ ID NO: 13559 - RNA, 60 nt, Human
ugaauauuacaacagugugggagagaaucaaccguaaaaaugucuucauuaauuagaccc

SEQ ID NO: 13560 - RNA, 62 nt, Human; identical to SEQ ID NO: 13558

SEQ ID NO: 13561 - RNA, 60 nt, Human; identical to SEQ ID NO: 13559

SEQ ID NO: 13562 - RNA, 62 nt, Human; identical to SEQ ID NO: 13558

SEQ ID NO: 13563 - RNA, 60 nt, Human; identical to SEQ ID NO: 13559

SEQ ID NO: 13564 - RNA, 62 nt, Human; identical to SEQ ID NO: 13558

SEQ ID NO: 13565 - RNA, 60 nt, Human; identical to SEQ ID NO: 13559

SEQ ID NO: 13566 - RNA, 62 nt, Human; identical to SEQ ID NO: 13558

SEQ ID NO: 13567 - RNA, 60 nt, Human; identical to SEQ ID NO: 13559

SEQ ID NO: 13568 - RNA, 62 nt, Human; identical to SEQ ID NO: 13558

SEQ ID NO: 13569 - RNA, 60 nt, Human; identical to SEQ ID NO: 13559

SEQ ID NO: 13570 - RNA, 62 nt, Human; identical to SEQ ID NO: 13558

SEQ ID NO: 13571 - RNA, 60 nt, Human; identical to SEQ ID NO: 13559

SEQ ID NO: 13572 - RNA, 62 nt, Human; identical to SEQ ID NO: 13558

SEQ ID NO: 13573 - RNA, 60 nt, Human; identical to SEQ ID NO: 13559

SEQ ID NO: 13574 - RNA, 62 nt, Human; identical to SEQ ID NO: 13558

SEQ ID NO: 13575 - RNA, 60 nt, Human; identical to SEQ ID NO: 13559

SEQ ID NO: 13576 - RNA, 62 nt, Human; identical to SEQ ID NO: 13558

SEQ ID NO: 13577 - RNA, 60 nt, Human; identical to SEQ ID NO: 13559

SEQ ID NO: 13578 - RNA, 62 nt, Human; identical to SEQ ID NO: 13558

SEQ ID NO: 13579 - RNA, 60 nt, Human; identical to SEQ ID NO: 13559

SEQ ID NO: 13580 - RNA, 62 nt, Human; identical to SEQ ID NO: 13558

SEQ ID NO: 13581 - RNA, 60 nt, Human; identical to SEQ ID NO: 13559

SEQ ID NO: 13582 - RNA, 62 nt, Human; identical to SEQ ID NO: 13558

SEQ ID NO: 13583 - RNA, 60 nt, Human; identical to SEQ ID NO: 13559

SEQ ID NO: 13584 - RNA, 62 nt, Human; identical to SEQ ID NO: 13558

SEQ ID NO: 13585 - RNA, 60 nt, Human; identical to SEQ ID NO: 13559

SEQ ID NO: 13586 - RNA, 62 nt, Human
uggccacccccugaugaguguuaccuggggaaagggcuagcaagaggugaagccuccugguc

SEQ ID NO: 13587 - RNA, 61 nt, Human
gccccugugaacagguauuuucaggacucaaacuaccacaaugaacagaguauagauuuua

SEQ ID NO: 13588 - RNA, 62 nt, Human; identical to SEQ ID NO: 13586

SEQ ID NO: 13589 - RNA, 61 nt, Human; identical to SEQ ID NO: 13587

SEQ ID NO: 13590 - RNA, 62 nt, Human; identical to SEQ ID NO: 13586

SEQ ID NO: 13591 - RNA, 61 nt, Human; identical to SEQ ID NO: 13587

SEQ ID NO: 13592 - RNA, 62 nt, Human; identical to SEQ ID NO: 13586

SEQ ID NO: 13593 - RNA, 61 nt, Human; identical to SEQ ID NO: 13587

SEQ ID NO: 13594 - RNA, 62 nt, Human
uuuuuuaguaaccuuggaagcuguaguaauucuaaggaaucaugaaccuugccuggacauuu

SEQ ID NO: 13595 - RNA, 62 nt, Human; identical to SEQ ID NO: 10378

SEQ ID NO: 13596 - RNA, 62 nt, Human
aggagcaaggccugcgagggaggaacgggccgcuccccgccagccgccuuccccagcagccg

SEQ ID NO: 13597 - RNA, 61 nt, Human; identical to SEQ ID NO: 13257

SEQ ID NO: 13598 - RNA, 62 nt, Human; identical to SEQ ID NO: 10519

SEQ ID NO: 13599 - RNA, 59 nt, Human
uauuuucuaagguugaucaucuuauaccacgaaucguuaauuuugacaguucuacugau

SEQ ID NO: 13600 - RNA, 62 nt, Human
gcggugagcaggggguucagcagcuugaccgaugccccccgagggggcucuccccagcuuaa

SEQ ID NO: 13601 - RNA, 62 nt, Human; identical to SEQ ID NO: 10207

SEQ ID NO: 13602 - RNA, 62 nt, Human; identical to SEQ ID NO: 9340

SEQ ID NO: 13603 - RNA, 62 nt, Human
aagugccuucugcaaaucauguuggaaaaguccaaaccuggagaugucccugugccuccgcc

SEQ ID NO: 13604 - RNA, 62 nt, Human; identical to SEQ ID NO: 11854

SEQ ID NO: 13605 - RNA, 62 nt, Human; identical to SEQ ID NO: 13074

SEQ ID NO: 13606 - RNA, 58 nt, Human; identical to SEQ ID NO: 9250

SEQ ID NO: 13607 - RNA, 58 nt, Human
ggcuauacuagcaacaaaaaaagaaugcuguuccugcaccugccgguuauuuccaaga

SEQ ID NO: 13608 - RNA, 62 nt, Human
ggggaggguccccgcaccuaccacuucuguuugccggugggaaacucacagagcaggacgcu

SEQ ID NO: 13609 - RNA, 62 nt, Human
agagcacaucuccacugacuuucauaaagcaaauguccaauauuuauuuauugagaguuuuu

SEQ ID NO: 13610 - RNA, 62 nt, Human
gugucaaccggcgccuguucccggugccuguggaucccgguacccccugccgccugugcagg

SEQ ID NO: 13611 - RNA, 62 nt, Human
ccugcccuccuugcagcccagcacaccugcagguguaagggacgauuggaguuucuucccag

SEQ ID NO: 13612 - RNA, 62 nt, Human; identical to SEQ ID NO: 10962

SEQ ID NO: 13613 - RNA, 62 nt, Human
cugaaauaucagguucuagaagaaacuggcgcuuaaaccaaaucgcauggauuucuuuuuca

SEQ ID NO: 13614 - RNA, 62 nt, Human
agccugaaucauuucuuauaccuucugacagcccaacuuccagaggacagcucugggguacu

SEQ ID NO: 13615 - RNA, 59 nt, Human
cuccagggcuggggccucgccuggcgggaccccgcagcagccccggccccauccccgcc

SEQ ID NO: 13616 - RNA, 62 nt, Human
cccaauggggggucccugagacuugcauguaaaacuagucuagaugucuucuuuuuuuguaa

SEQ ID NO: 13617 - RNA, 60 nt, Human
caccugguaucucgagugccugcaguugcaaguauguuuacaccugguguccaauuuugu

SEQ ID NO: 13618 - RNA, 62 nt, Human
cagagaguagccaaccagagaccuuugcuuugauaucaucaacugcagagaaugcuguugau

SEQ ID NO: 13619 - RNA, 56 nt, Human
guagcuuuggagugaaacuuuggcugcaauaggcuacuuuggcaagcccuccguaa

SEQ ID NO: 13620 - RNA, 62 nt, Human
gacauagcugcuccuggucaguggaggucagccggguaucaaaagccaugaaacugugucuc

SEQ ID NO: 13621 - RNA, 62 nt, Human
cccaaaucgcuuccccgagagugaauuuuaacacuguaacaauaaauacuacugcacagcac

SEQ ID NO: 13622 - RNA, 62 nt, Human; identical to SEQ ID NO: 12142

SEQ ID NO: 13623 - RNA, 52 nt, Human
uuuguguauaauuauuauauuugacgguuacauucuugugcuucguguccug

SEQ ID NO: 13624 - RNA, 62 nt, Human
uuuucccugauggaauuuaccuuaaucuguauauaacuuguaauuuuuucuaauucauuucu

SEQ ID NO: 13625 - RNA, 62 nt, Human
cgcggcugguuuagauugugguuguuuguuuugcuucuacuaagacuguuuuguuucaaaaa

SEQ ID NO: 13626 - RNA, 62 nt, Human
aaacuuauuugaaaaguugucucaagucaaauggauucaucaccugucaugcauugacaccu

SEQ ID NO: 13627 - RNA, 60 nt, Human; identical to SEQ ID NO: 11388

SEQ ID NO: 13628 - RNA, 62 nt, Human
uccuguccugccugacaguucgcucauuccaacuaaucaucaucuucaaguuuuccaccaag

SEQ ID NO: 13629 - RNA, 60 nt, Human
uggucuaucuuuuaaagccugaucuggugugaauaaucaacuaggaaaucuaaacuugga

SEQ ID NO: 13630 - RNA, 62 nt, Human
cagauaauauguuuuuuccuacuucaacagaagaacaauauaaaauuaauaucuauuaccaa

SEQ ID NO: 13631 - RNA, 62 nt, Human
aacugaaauaucagguucuagaagaaacuggcgcuuaaaccaaaucgcauggauuucuuuuu

SEQ ID NO: 13632 - RNA, 62 nt, Human; identical to SEQ ID NO: 10141

SEQ ID NO: 13633 - RNA, 60 nt, Human
auuugaauuuuuacauuuguuguacaaucaggaaaagcaauaaagauuuuucaaaaauag

SEQ ID NO: 13634 - RNA, 62 nt, Human
caguuugacggcacggugcggauacaggacuccaucaggcuaguguuggggaaccagcccgg

SEQ ID NO: 13635 - RNA, 62 nt, Human
guuguuuaaauuuguuaacuuuuuauauuaaugacuauugaaagugguaauaaaaauuuaua

SEQ ID NO: 13636 - RNA, 62 nt, Human
ucgauccuggagcccccgcaccgguaccacauccaccggcgaaagagcuuugacgccucuga

SEQ ID NO: 13637 - RNA, 57 nt, Human
ggguacuccuuucggccccccugguagagucucgggaguucacacaggguggcaaac

SEQ ID NO: 13638 - RNA, 62 nt, Human
ucauggguuuggcuuaggcugguagcuucuauguaauucgcaaugauuccaucuaaauaaaa

SEQ ID NO: 13639 - RNA, 60 nt, Human
uuucccaccccagcugccccagcacgcgggacccauagcacaccccuuagcgcuugccua

SEQ ID NO: 13640 - RNA, 62 nt, Human; identical to SEQ ID NO: 9384

SEQ ID NO: 13641 - RNA, 60 nt, Human
cagagccaggugagggggggccugccaggacuagacagaaguggggcggccugaacccug

SEQ ID NO: 13642 - RNA, 62 nt, Human; identical to SEQ ID NO: 12033

SEQ ID NO: 13643 - RNA, 62 nt, Human; identical to SEQ ID NO: 12034

SEQ ID NO: 13644 - RNA, 62 nt, Human; identical to SEQ ID NO: 9695

SEQ ID NO: 13645 - RNA, 60 nt, Human
gccgcagggacgacacucuccagggaggccccagcaaccacaccaucuucuugcugugag

SEQ ID NO: 13646 - RNA, 49 nt, Human
gagcacugccgccacuaugaggacuccuaccgggugagggggcagggau

SEQ ID NO: 13647 - RNA, 60 nt, Human
agcaugacuaaacugcaaaaaaaaaaaaagagcuacuguauuuagacuuaggaaaaaagg

SEQ ID NO: 13648 - RNA, 62 nt, Human; identical to SEQ ID NO: 10354

SEQ ID NO: 13649 - RNA, 61 nt, Human
ugggggaacgcagguucccagcugcgccccucccccgcgcacacacacccuccccuguccc

SEQ ID NO: 13650 - RNA, 62 nt, Human
uuccagagugcuauaaucuagauguaauguugucacuaauuaauugccauuacucccaguua

SEQ ID NO: 13651 - RNA, 62 nt, Human
cacaggugagcauguucuuucuggugaccugguauuccaucaccauucaccccaggggacag

SEQ ID NO: 13652 - RNA, 62 nt, Human
uuuucuaaaucauuuuuuauuaaaugaauccaaaguauccuagcucuuugucaaagaugguc

SEQ ID NO: 13653 - RNA, 61 nt, Human
gucagagaagcagccaugacugcggggggaggacacacggaugcucaggcccaggcuuugc

SEQ ID NO: 13654 - RNA, 62 nt, Human; identical to SEQ ID NO: 9529

SEQ ID NO: 13655 - RNA, 62 nt, Human
gaggcucaacccgacggaucacagugaaagggauuccucccacgccagaucugcacaacgag

SEQ ID NO: 13656 - RNA, 62 nt, Human
ccuuguccuccccaguuggccuacuguuacacauuaaaacgauuugcccagcuccuucugug

SEQ ID NO: 13657 - RNA, 62 nt, Human; identical to SEQ ID NO: 9225

SEQ ID NO: 13658 - RNA, 62 nt, Human
ggcuuuuuuguuuuaaaagugguuggggauccacaggaacgacauucauacagggacauuug

SEQ ID NO: 13659 - RNA, 52 nt, Human
cgggaacaggagauccucugucgccccugugagcugagcugguuaggaacca

SEQ ID NO: 13660 - RNA, 62 nt, Human; identical to SEQ ID NO: 10329

SEQ ID NO: 13661 - RNA, 60 nt, Human
agaacagcauuggucccagagcccugggcaucagaccuuaaccaccaggcccacagccca

SEQ ID NO: 13662 - RNA, 62 nt, Human
gcaggggcauuggggacugucuugagacccugagggggucaagccccuccuuccccagcugc

SEQ ID NO: 13663 - RNA, 62 nt, Human
cucagccucccgaguagcugggauuacaggcaugugccaccacgcccggcuaauguuuguau

SEQ ID NO: 13664 - RNA, 62 nt, Human; identical to SEQ ID NO: 12917

SEQ ID NO: 13665 - RNA, 60 nt, Human
uuaauuucccuuagaaguuccaagcccuguuuccugcguaaaggugguauguccaguuca

SEQ ID NO: 13666 - RNA, 62 nt, Human; identical to SEQ ID NO: 11767

SEQ ID NO: 13667 - RNA, 62 nt, Human; identical to SEQ ID NO: 11768

SEQ ID NO: 13668 - RNA, 62 nt, Human
caauuuugcaaauugcauucugaugcuugugaugaacacaaauguacuuguguagagacauu

SEQ ID NO: 13669 - RNA, 62 nt, Human
ucugaccgucucauaaaagaguucuacccagcaguuggcagauuaucagcuguggacuccag

SEQ ID NO: 13670 - RNA, 62 nt, Human; identical to SEQ ID NO: 13668

SEQ ID NO: 13671 - RNA, 62 nt, Human; identical to SEQ ID NO: 13669

SEQ ID NO: 13672 - RNA, 53 nt, Human
gcuaucagaggaagaaauagaaaaaggcguagagauagaagagaagauagugg

SEQ ID NO: 13673 - RNA, 62 nt, Human; identical to SEQ ID NO: 11421

SEQ ID NO: 13674 - RNA, 62 nt, Human; identical to SEQ ID NO: 9741

SEQ ID NO: 13675 - RNA, 60 nt, Human
ggugggaggggccccauccaaaggaugcccuggccagcgaggcugggucacaggucaggg

SEQ ID NO: 13676 - RNA, 62 nt, Human; identical to SEQ ID NO: 9741

SEQ ID NO: 13677 - RNA, 60 nt, Human; identical to SEQ ID NO: 13675

SEQ ID NO: 13678 - RNA, 62 nt, Human
gugggccuggcagacccuucaugagugggacccaagauaucacugacuucaacccagaggau

SEQ ID NO: 13679 - RNA, 62 nt, Human
ggagggagucuccacguuugacauuccaucagauuucguccaaaagcucagucagacuucug

SEQ ID NO: 13680 - RNA, 62 nt, Human
ugaaaucuauuauuuuaguuagccuacuuggcauuuacuacaucggucacuucuccaggcug

SEQ ID NO: 13681 - RNA, 61 nt, Human
gugacugaaaccuacugagcuauauucacugugcuguccuagggggagggagagcagagcu

SEQ ID NO: 13682 - RNA, 62 nt, Human; identical to SEQ ID NO: 11846

SEQ ID NO: 13683 - RNA, 54 nt, Human
uuuuaaguaccaccauuugaaccuuaacgaagaaaaaaaucuucaaguagaccu

SEQ ID NO: 13684 - RNA, 62 nt, Human
caggccacugugagggugggugcuggcugagcccccggggcagcaggagccaggcaggugau

SEQ ID NO: 13685 - RNA, 62 nt, Human
gccuuggccccacagcccagcuccaugaccuucuccagcugaggcaggagaaugccuaccug

SEQ ID NO: 13686 - RNA, 62 nt, Human; identical to SEQ ID NO: 12231

SEQ ID NO: 13687 - RNA, 62 nt, Human
ucuccugcagucuguggagcguccuuguccccgccgccggaaugaaugagcauucugcagcc

SEQ ID NO: 13688 - RNA, 62 nt, Human
aaugaauacuacuuagagcuacacucaccacuucccuagacagccuuuaauaggcaugauaa

SEQ ID NO: 13689 - RNA, 60 nt, Human
cagggucuggcugcacauuggugcuguggugaacuugcgaguaaucguuaccugccucua

SEQ ID NO: 13690 - RNA, 62 nt, Human; identical to SEQ ID NO: 12737

SEQ ID NO: 13691 - RNA, 62 nt, Human
ucaggaccccacucaucuagcccuccaagagccuccgccaaauuguagccauguaauuggaa

SEQ ID NO: 13692 - RNA, 62 nt, Human
gggccagcucggcggccugcugguccucugcuugcuggaacauucuaacauuuacacuuuug

SEQ ID NO: 13693 - RNA, 56 nt, Human
cugccccuggcuccuuaaaugccccgucucuuuguaaacugauauucagccagcaa

SEQ ID NO: 13694 - RNA, 62 nt, Human
uccauuuuguuuccuugauugcauuuuuguucuuuuagcagaucugucccuguggguggugu

SEQ ID NO: 13695 - RNA, 58 nt, Human
uuggggguacgauguuuauacuccguaaagaacauacaaggacauucacugcugauuu

SEQ ID NO: 13696 - RNA, 62 nt, Human
acccuaccccacccucuuugaaaagacaaagcucugccuacauagaagacuuuuuuuauuuu

SEQ ID NO: 13697 - RNA, 62 nt, Human
aggccacaccaggcccaacccugugcuggucaagccagggcagucacagcugcuuggggccc

SEQ ID NO: 13698 - RNA, 62 nt, Human
agacccauguaacccacuggcuccugcauuaacccagaaauaccucgcuucuaucugugcac

SEQ ID NO: 13699 - RNA, 58 nt, Human
caggcugggccccuggcgugcccugaccgugcagcagagugaggcuggggcagcagag

SEQ ID NO: 13700 - RNA, 62 nt, Human; identical to SEQ ID NO: 12805

SEQ ID NO: 13701 - RNA, 62 nt, Human; identical to SEQ ID NO: 12806

SEQ ID NO: 13702 - RNA, 62 nt, Human; identical to SEQ ID NO: 9234

SEQ ID NO: 13703 - RNA, 62 nt, Human; identical to SEQ ID NO: 9235

SEQ ID NO: 13704 - RNA, 62 nt, Human
uccccggcccuuugcacaggugagggaacuaaaccugugcaagaugggagaccgggguggga

SEQ ID NO: 13705 - RNA, 61 nt, Human
uuggagcugaagaccuaaagugcuugcuuuuugcccguugaccagauaaauagaacuaucu

SEQ ID NO: 13706 - RNA, 62 nt, Human
agggcuugggagauucaugcgauguguccaaucggagacaaaagcaguuucucuccaacucc

SEQ ID NO: 13707 - RNA, 62 nt, Human; identical to SEQ ID NO: 11454

SEQ ID NO: 13708 - RNA, 62 nt, Human; identical to SEQ ID NO: 9945

SEQ ID NO: 13709 - RNA, 61 nt, Human
ucuaaauguuucugcuucccagaaugcaccugacuuaugaaauggggauaauacucccagg

SEQ ID NO: 13710 - RNA, 62 nt, Human
aggacagggccugugggcuccagcagcccaggaggcgaggaaggcugggcgagcucuagccc

SEQ ID NO: 13711 - RNA, 55 nt, Human
aaacaagaggaagccucggccucccugagcucugaccccagccucacccgaaagg

SEQ ID NO: 13712 - RNA, 62 nt, Human
augauugcuuuugagggcccggaauuauaaauauauauuauauuuuaauuguuugagauuau

SEQ ID NO: 13713 - RNA, 60 nt, Human
guuguaaagauguauguuuuuaccugacaguuauaccacagguagacugucaaguugaga

SEQ ID NO: 13714 - RNA, 62 nt, Human; identical to SEQ ID NO: 11781

SEQ ID NO: 13715 - RNA, 54 nt, Human
caacaucuugguaaacaacagacugcauauaugaugguggucauccaguaagcu

SEQ ID NO: 13716 - RNA, 62 nt, Human; identical to SEQ ID NO: 12373

SEQ ID NO: 13717 - RNA, 62 nt, Human
cacacuaauaaccccuggauggucaaucugauaauaggaucagauuuacgucuacccuaauu

SEQ ID NO: 13718 - RNA, 62 nt, Human
cccuccauaauuaagaugaaacauuccgguuuucucacaacacauuagcacauacuguccau

SEQ ID NO: 13719 - RNA, 54 nt, Human
uucccucccuggggucucacacgcucccacgagaaugccacaggggccgugcac

SEQ ID NO: 13720 - RNA, 62 nt, Human; identical to SEQ ID NO: 10863

SEQ ID NO: 13721 - RNA, 62 nt, Human
uucugcggccccccaggugcuaugggggaggggggcguugaauggaauuaaaccagaaagaa

SEQ ID NO: 13722 - RNA, 62 nt, Human; identical to SEQ ID NO: 11044

SEQ ID NO: 13723 - RNA, 62 nt, Human; identical to SEQ ID NO: 10122

SEQ ID NO: 13724 - RNA, 62 nt, Human
uugaacuggcucccggggaacauucagagcaugauugguagacagaagggugcagaggcgcc

SEQ ID NO: 13725 - RNA, 62 nt, Human
acacauauuacacacaugugcgcauuacacacacacaauacacauacaugcauauagacgca

SEQ ID NO: 13726 - RNA, 62 nt, Human
gacaccuugguuuuuguguuagauugagcugggcagcugcaaucagcuucuuuauaugcaaa

SEQ ID NO: 13727 - RNA, 60 nt, Human
uguguuaugccacuacucauguugucuuagguacuacgcauaauguuaauagcugagaug

SEQ ID NO: 13728 - RNA, 62 nt, Human; identical to SEQ ID NO: 10752

SEQ ID NO: 13729 - RNA, 49 nt, Human; identical to SEQ ID NO: 9300

SEQ ID NO: 13730 - RNA, 62 nt, Human
agcccucagcgugucuuuucagcaggagcagaaccgaugagagccgcccuuaccguuggucu

SEQ ID NO: 13731 - RNA, 58 nt, Human
ggcaaucacugggacccgcaugguguuccuccaaagaauaggguaaaggagagcuggg

SEQ ID NO: 13732 - RNA, 62 nt, Human; identical to SEQ ID NO: 11978

SEQ ID NO: 13733 - RNA, 57 nt, Human
cucgauacguuuggucuuucaugcugaaaaauaaauaauaaagccugucccgugucu

SEQ ID NO: 13734 - RNA, 62 nt, Human; identical to SEQ ID NO: 11527

SEQ ID NO: 13735 - RNA, 62 nt, Human; identical to SEQ ID NO: 11528

SEQ ID NO: 13736 - RNA, 62 nt, Human
uccaccucccaaauccaggcccggcccccucuggcuuggagagcauuccaagcccccacccc

SEQ ID NO: 13737 - RNA, 62 nt, Human
uuagcggucauuaucgugucuguuggugaaauuuuuauuaaaaggaaaauucuguagaugca

SEQ ID NO: 13738 - RNA, 62 nt, Human; identical to SEQ ID NO: 12478

SEQ ID NO: 13739 - RNA, 62 nt, Human
ucucgugcgggcgcgugaguggucuucaaacgagggucccgauccccggggcggcaggaagg

SEQ ID NO: 13740 - RNA, 62 nt, Human
cagccaccaugcugacggguauuuuuccucauaaaguuuauaaccaguuauuuauaugaauc

SEQ ID NO: 13741 - RNA, 57 nt, Human
ggacgugcccauuuuuacuguaaauuaugauuccguaacugacuuguaguaagcagu

SEQ ID NO: 13742 - RNA, 62 nt, Human
uguacuuuucauaaugguuuccaugaauguaguacguucauacaggcuucauucaaccuggc

SEQ ID NO: 13743 - RNA, 62 nt, Human
aagaaaaaaugaugauagagucccaaaaagaagagaaaaaaaaugcccaaguugcccuuuaa

SEQ ID NO: 13744 - RNA, 62 nt, Human
cugccgggugcccgcguggggucgcggaagggaauggauagacuggugugcucaaaagagag

SEQ ID NO: 13745 - RNA, 61 nt, Human
ccucugacccaccuaccaccagaggccugcagccucccacaugccuuaaggggaccguggc

SEQ ID NO: 13746 - RNA, 62 nt, Human
uuauuauuaauauuauuaugcagcccgacaaugucgaguauacggacucccgggccacgccc

SEQ ID NO: 13747 - RNA, 62 nt, Human; identical to SEQ ID NO: 9817

SEQ ID NO: 13748 - RNA, 62 nt, Human
gccuaagcaaaaggacaggcuguccaagguagaaacuguacauagccggugaccgaaugcga

SEQ ID NO: 13749 - RNA, 62 nt, Human
ccaauuuacuugugaaagaaguuuuaucuuuauggacuaugaugacuuuugacaucaccauu

SEQ ID NO: 13750 - RNA, 62 nt, Human
ucccgucccccugcccaagugacugaaaccuacugagcuauauucacugugcuguccuaggg

SEQ ID NO: 13751 - RNA, 62 nt, Human; identical to SEQ ID NO: 12709

SEQ ID NO: 13752 - RNA, 62 nt, Human
ucuugaggcuuccccagccauauggaacuauaagucaauuaaaccucuuuccuuuuauaaau

SEQ ID NO: 13753 - RNA, 62 nt, Human
ggcauugcccacuucggcccagccacguguuugcagcgaccagagucccugcaaaggugugg

SEQ ID NO: 13754 - RNA, 62 nt, Human
gcacaaagcauacucuugccccucagguguugcuuguguacaucguacccauccauucggcu

SEQ ID NO: 13755 - RNA, 57 nt, Human
aaaaacccugucuuuuugcacgauacagccaaaaguauuggcugauuucuugcugag

SEQ ID NO: 13756 - RNA, 62 nt, Human
guucuuaacuaccaugauugcuuuugagggcccggaauuauaaauauauauuauauuuuaau

SEQ ID NO: 13757 - RNA, 62 nt, Human
gguaaaacaaaugaaauuaagugauccaaagcugcugaaguauguuugaacucuccagugcc

SEQ ID NO: 13758 - RNA, 62 nt, Human
gggaaaguuggagaagccguggccuugcgagaggugguuacaccagaaccuggacauuggcc

SEQ ID NO: 13759 - RNA, 61 nt, Human
ccuucaagauuccauuucuuaacagucuccaaucccaucuauucucugccuuuacuauaug

SEQ ID NO: 13760 - RNA, 62 nt, Human
cguuuuaggaucuguacauagagaaauauuuaaauuuuuagaagcaaaacuuauacaacauu

SEQ ID NO: 13761 - RNA, 54 nt, Human
uccauuaucuucaugacauucggccucauccauaggguccugaagcugcagucc

SEQ ID NO: 13762 - RNA, 62 nt, Human
aaaagguugauuuuucuuaauagauucuggauuccacucacagggagaugggauuccuuucu

SEQ ID NO: 13763 - RNA, 62 nt, Human
aaccccgucucuacuaaaaauacaaaaaauuagccgggcguaguggcgggcgccuguagucc

SEQ ID NO: 13764 - RNA, 62 nt, Human
cuggacugucuuccucaucucuguagcaccaagccugauagaucuguauaugguaaacaggg

SEQ ID NO: 13765 - RNA, 60 nt, Human
cccuugaucuagaugggauucuuauaaaaauucaaccucagacauaaacaccccauuucu

SEQ ID NO: 13766 - RNA, 62 nt, Human
uugggagaccgaggcagguggaucacgaggucaggagauagagaccauccuggccaacacgg

SEQ ID NO: 13767 - RNA, 59 nt, Human
cuugacaaaguacuauacagcugaagaacaucucgaauacaauuuuggugggaaaggag

SEQ ID NO: 13768 - RNA, 62 nt, Human; identical to SEQ ID NO: 9304

SEQ ID NO: 13769 - RNA, 60 nt, Human
uguguauauauagaagguagaaaugaaaagugagaaaauauuugaaagggauuauauuaa

SEQ ID NO: 13770 - RNA, 62 nt, Human
ccuggugcccacucccgccagccccugccucgaggacugauacugcagugacugccgucagc

SEQ ID NO: 13771 - RNA, 62 nt, Human
uagauaauggagaaauuuucuaucucugucccuauuuguauaagccaaggugaugcugggug

SEQ ID NO: 13772 - RNA, 62 nt, Human
cgagaucaggaguucaagaccagccuggccaauaugaugaaaccccgucucuacuaaaaaua

SEQ ID NO: 13773 - RNA, 62 nt, Human
cauagagaaauauuuaaauuuuuagaagcaaaacuuauacaacauuaaaaugauaccaaguc

SEQ ID NO: 13774 - RNA, 62 nt, Human
ccccgugccccuugaugcccccuccccacagugcucaggagacccguggggcacggaacagg

SEQ ID NO: 13775 - RNA, 62 nt, Human; identical to SEQ ID NO: 10319

SEQ ID NO: 13776 - RNA, 62 nt, Human
ucccaagucgcugccagacaccacccacugcuucgccggacaaugucgaaguccagucugug

SEQ ID NO: 13777 - RNA, 61 nt, Human
accccucgcagcgaggagaaucgcugccccgccccggaccauucagcggaccgcgggcgcc

SEQ ID NO: 13778 - RNA, 62 nt, Human
uauuccccauccaggccucaccaaugcagaugcugcccccgaccccgaccuggucagugccc

SEQ ID NO: 13779 - RNA, 62 nt, Human
aaaaugccaaacuaguaagcaggauagcugauaccacggcuaugagggaguaggcucugaga

SEQ ID NO: 13780 - RNA, 62 nt, Human; identical to SEQ ID NO: 9348

SEQ ID NO: 13781 - RNA, 62 nt, Human
cgugcugagcuccagguauaguggaccccagggugccucauaccagccaguuagagagcaua

SEQ ID NO: 13782 - RNA, 62 nt, Human; identical to SEQ ID NO: 13736

SEQ ID NO: 13783 - RNA, 61 nt, Human
gcaccaggcugccucugcucuuggaaaacuaggaaaggggaucagaaacauccucuccccg

SEQ ID NO: 13784 - RNA, 62 nt, Human
uuugggaggaagccuaucagcgaguggcuaaugagcaggagauuuaugaagguuccagacag

SEQ ID NO: 13785 - RNA, 61 nt, Human
cuuguuugccccucagcgugccaggcagacugggggcaggacagccggaagcugagaccaa

SEQ ID NO: 13786 - RNA, 62 nt, Human; identical to SEQ ID NO: 10013

SEQ ID NO: 13787 - RNA, 62 nt, Human; identical to SEQ ID NO: 10014

SEQ ID NO: 13788 - RNA, 62 nt, Human
acagaccaggucaucuggcuuccgagaucaucagagaagauaagucugucucuuucagcugc

SEQ ID NO: 13789 - RNA, 58 nt, Human
ugguuuguggaauccauuaugaagugcaauuagauagauguagguuccugccguuugg

SEQ ID NO: 13790 - RNA, 62 nt, Human
acaugccaauccugagaauaaccuccccuccagccagagauauuccaacucugcaauaaaac

SEQ ID NO: 13791 - RNA, 59 nt, Human
aagcuuuguguccccacccacaucucaucuugaaugguaauccuggguguuuagggaga

SEQ ID NO: 13792 - RNA, 62 nt, Human
uguucuuuuagcagaucugucccuguggguggugucuaagaagucggacaccuugguuuuug

SEQ ID NO: 13793 - RNA, 61 nt, Human
gaugcgucaacaaaauugagccauuuuuuuaaaguaauagauacuaauagauuaucuuuuc

SEQ ID NO: 13794 - RNA, 62 nt, Human; identical to SEQ ID NO: 9234

SEQ ID NO: 13795 - RNA, 62 nt, Human; identical to SEQ ID NO: 9235

SEQ ID NO: 13796 - RNA, 62 nt, Human
agagggacggcccccacggcccagcagacaugcgagcuuccagagugcaaucuaugugaugu

SEQ ID NO: 13797 - RNA, 62 nt, Human; identical to SEQ ID NO: 9292

SEQ ID NO: 13798 - RNA, 62 nt, Human; identical to SEQ ID NO: 12815

SEQ ID NO: 13799 - RNA, 62 nt, Human
cauuuauaaagaccguacaaacucagauccuugguaccccuaaaaagauugccaauuuucuu

SEQ ID NO: 13800 - RNA, 62 nt, Human
gaguaggaaaagagaagggcuagaacugguccagccgacgaaugauuggcaucacauugauc

SEQ ID NO: 13801 - RNA, 62 nt, Human
ccucaaaauguuucaaaugccuaccgccucuagaucgagccacguugacuucagguggucuu

SEQ ID NO: 13802 - RNA, 62 nt, Human; identical to SEQ ID NO: 10359

SEQ ID NO: 13803 - RNA, 62 nt, Human; identical to SEQ ID NO: 12540

SEQ ID NO: 13804 - RNA, 62 nt, Human
cuggaucgccuucuucaccacggccagcgucuacgacggcaaguaccugccugcggccaaca

SEQ ID NO: 13805 - RNA, 60 nt, Human
agggagucuccacguuugacauuccaucagauuucguccaaaagcucagucagacuucug

SEQ ID NO: 13806 - RNA, 62 nt, Human; identical to SEQ ID NO: 13804

SEQ ID NO: 13807 - RNA, 60 nt, Human; identical to SEQ ID NO: 13805

SEQ ID NO: 13808 - RNA, 62 nt, Human
cauaagaaaaccacccacaagcucaacugugacccaagcagaaucuacaaaccccagacaag

SEQ ID NO: 13809 - RNA, 62 nt, Human
ccuuuuucucaggaagaggugauggcaauguaaaacaucuaagcaaaguuuuaaaugaaaaa

SEQ ID NO: 13810 - RNA, 62 nt, Human
uggaaaagggaaacccucuggcuguaggggccucucggccaaaacuaaaacagcccugagca

SEQ ID NO: 13811 - RNA, 62 nt, Human
cagagggcaugagggucacaggucagcaaggugugaggagcacaagccagggugccccgagg

SEQ ID NO: 13812 - RNA, 62 nt, Human
uuaugauuugugcauguauuuuuauaugaaaaaaacuuacaaagauaugcaaauuaaacuuc

SEQ ID NO: 13813 - RNA, 62 nt, Human
cuccccccgcccccaagugugacuccagauggccaggguguacaccaccuuucggccacuau

SEQ ID NO: 13814 - RNA, 62 nt, Human; identical to SEQ ID NO: 11929

SEQ ID NO: 13815 - RNA, 60 nt, Human
ugggccccuuucccuuaggauggguaucaauucaacaauauuuauaaggcauuuacugug

SEQ ID NO: 13816 - RNA, 62 nt, Human
ccaccgcuuuauuucuuucgguuucggaugcaaaacaaaaaauuuuaaaagaaaaugugacu

SEQ ID NO: 13817 - RNA, 61 nt, Human
gaaccucauggguuuggcuuaggcugguagcuucuauguaauucgcaaugauuccaucuaa

SEQ ID NO: 13818 - RNA, 58 nt, Human
uaagaagagcauugaacugaggaaagcuaagaggaagauucaauauuaacuagcuuga

SEQ ID NO: 13819 - RNA, 62 nt, Human
ugaaccucucuccccugcgucgccaccucuguaauugauguacauaccgcaaaccgugugug

SEQ ID NO: 13820 - RNA, 62 nt, Human
gaaugggcuuuguccuccaggaggugggggaaugugguaacauugaauacaguugaauaaaa

SEQ ID NO: 13821 - RNA, 60 nt, Human
gaaacccccucuggugcuugguugaacaagggaaucacaagaaaacgaaaaugcaaaaac

SEQ ID NO: 13822 - RNA, 62 nt, Human
cuggauuaaagaaguuuuccaguuccaaaaauuaaaggaauauauccuuaugaugugugugu

SEQ ID NO: 13823 - RNA, 55 nt, Human
cucccuccuguuucaggugggucacauucugaugaauguuucccuuguacagauc

SEQ ID NO: 13824 - RNA, 62 nt, Human; identical to SEQ ID NO: 10430

SEQ ID NO: 13825 - RNA, 59 nt, Human
ccugaacugaaggcgcucccuauuuggucucgcgacacagggacuauuuucagcacgcc

SEQ ID NO: 13826 - RNA, 62 nt, Human
ggcgaccagcccagaagaggcccacccucucgguccggaacaagacgccucggccacggcuc

SEQ ID NO: 13827 - RNA, 62 nt, Human
ccaggacuccuaucgagagccccagacccaggcuagccgcuacaugucccugucccuucgcu

SEQ ID NO: 13828 - RNA, 62 nt, Human
cugucacucucucccacccccgggcagcuguuuugcccaagaccacugcuaccuguuuaccc

SEQ ID NO: 13829 - RNA, 61 nt, Human
cccccaugccuggcugauccgccccgcucggauccgcuggaaaguccuccagagcucugug

SEQ ID NO: 13830 - RNA, 62 nt, Human
acaaguguucuauuuauuucuuguauuguuuggaagaaaaaaugaugauagagucccaaaaa

SEQ ID NO: 13831 - RNA, 62 nt, Human
aaccuccccuccagccagagauauuccaacucugcaauaaaacucuccuucacacagaaaca

SEQ ID NO: 13832 - RNA, 62 nt, Human
uauccauccauauucagcuagcuuucaaaugggguaacgauauuuucugcauagauuuucuu

SEQ ID NO: 13833 - RNA, 62 nt, Human; identical to SEQ ID NO: 13410

SEQ ID NO: 13834 - RNA, 62 nt, Human
gucucccauguaccagagaaggaaaagucugaucccgaaacagcuugaacgaaaggugguua

SEQ ID NO: 13835 - RNA, 57 nt, Human
uaaugauuuuuuaauuaaaaaaaagaacaacaggauagagcuguugggguggcacag

SEQ ID NO: 13836 - RNA, 62 nt, Human
gaccuucuguaguaauaaaguuuuugccacuguaaauaaaaacaguauccguagcuaucagg

SEQ ID NO: 13837 - RNA, 60 nt, Human
cacuuuacccccacagaagucuagaggcgucuguuauaaagcguuacggggcgccugcau

SEQ ID NO: 13838 - RNA, 62 nt, Human
aagggaggagacaucuggccuuuuuagaaccugagaggaaaaaaagagucuuuuuuuccccu

SEQ ID NO: 13839 - RNA, 50 nt, Human
uccguguguucucauuuccuucacuguuuauuuuuguuuguuuguuuguu

SEQ ID NO: 13840 - RNA, 62 nt, Human
uuuuuggcauuagacauucuuauugugaagaaauaauguuaauauaaguaucuggugaagga

SEQ ID NO: 13841 - RNA, 62 nt, Human
cugcugucuaggaccaccugcccuaaccaggaauaaaggcaagacagccuggagaccaguuu

SEQ ID NO: 13842 - RNA, 62 nt, Human
ucaaauguguucagaggaaauagaauguaaaacaucacaaaaaaaauugcaguacauaaaau

SEQ ID NO: 13843 - RNA, 62 nt, Human; identical to SEQ ID NO: 12142

SEQ ID NO: 13844 - RNA, 62 nt, Human
auuccugccuguaagucuucccaagacagaggcccggugacacaguucagccaggacugacc

SEQ ID NO: 13845 - RNA, 58 nt, Human
accccguuaucuauauuuuaaaugcuuuuugcccaacacugacccuauguucaacuuu

SEQ ID NO: 13846 - RNA, 62 nt, Human; identical to SEQ ID NO: 10042

SEQ ID NO: 13847 - RNA, 61 nt, Human
cggggaaggcacugguuaggaaggauguucaaacggucccacccaagccugucaccucugc

SEQ ID NO: 13848 - RNA, 62 nt, Human; identical to SEQ ID NO: 9514

SEQ ID NO: 13849 - RNA, 60 nt, Human
aggcgcggggccacacccgugaaccaugcagacggccgaagaagucuuaggcagggcgcc

SEQ ID NO: 13850 - RNA, 62 nt, Human
aagcauacucuugccccucagguguugcuuguguacaucguacccauccauucggcuucacc

SEQ ID NO: 13851 - RNA, 62 nt, Human
ccugguugggugggugguggauucuuggacgugugugucauacaagcauagacuggauuaaa

SEQ ID NO: 13852 - RNA, 62 nt, Human
aaugugugacuuacuaucuugggccagaacuaagaaugccaagguuuuauauaugugugugu

SEQ ID NO: 13853 - RNA, 60 nt, Human
aagaugcagacuggucuuuuagagacggcaugguauauuacuauuuccacauaaugagga

SEQ ID NO: 13854 - RNA, 62 nt, Human; identical to SEQ ID NO: 9607

SEQ ID NO: 13855 - RNA, 61 nt, Human
uugcuugcgucucgaaucuucgguucucgaggaaguguugacagugugaugcuaaugucug

SEQ ID NO: 13856 - RNA, 62 nt, Human
auuuuuggcauuagacauucuuauugugaagaaauaauguuaauauaaguaucuggugaagg

SEQ ID NO: 13857 - RNA, 58 nt, Human
ugagugacacuucauuguaauucacaguguaaauuuaauccaaacugaaauuuuguuu

SEQ ID NO: 13858 - RNA, 62 nt, Human
cagcaagaauguucgugcuuuuuuccagagaggggaaccccacugguuuuuguggaaacaau

SEQ ID NO: 13859 - RNA, 62 nt, Human
ucuaaggcccucauuuccugcacuguguucucagguacaugagcaaucucagggauagccag

SEQ ID NO: 13860 - RNA, 62 nt, Human
accgcuaagcaagcauugucugugccauaacacaguacuagaccacuuucuuacuucucuuu

SEQ ID NO: 13861 - RNA, 62 nt, Human
aaagggaggaggucguaaggacacacagcugaugaagggucagugcucagcuaucaagguca

SEQ ID NO: 13862 - RNA, 62 nt, Human
gccucccacaugccuuaaggggaccguggcccccaccagggacguccugcgccauccguuca

SEQ ID NO: 13863 - RNA, 62 nt, Human
gcugucaugcgguuuccaaggugcacauuuuccacggaaacagaacucgaugcacugaccug

SEQ ID NO: 13864 - RNA, 62 nt, Human
ugcguguccgaaagaacuuaacguuuuaaaggugauugucaaguaacugugugggguucuaa

SEQ ID NO: 13865 - RNA, 62 nt, Human
gcuauggucuguaaaaugaaacaaaaaaacuuuauuucacuauaagaguacuuuauuuuaaa

SEQ ID NO: 13866 - RNA, 62 nt, Human
gaccacugcuaccuguuuacccacccuggucccucccagacaagcaaggccucugauuucuu

SEQ ID NO: 13867 - RNA, 62 nt, Human
cagguuggugauucaguccgaccuucuuuagguaaccgagcauuuauuuaaccaacuauacc

SEQ ID NO: 13868 - RNA, 62 nt, Human
ugggaauugcaagcuuucuuaagaaaucucuauuuuauuacaguuauccuucuuugugcgau

SEQ ID NO: 13869 - RNA, 62 nt, Human
aguauugaaaaagaaaucaaauguaaaugucugguuuucauauaauguuuaaaaagaccauu

SEQ ID NO: 13870 - RNA, 62 nt, Human; identical to SEQ ID NO: 9365

SEQ ID NO: 13871 - RNA, 61 nt, Human
agguccaggggcugugggggcggggcgccgggucgggccgagugcagcaccagguucuuga

SEQ ID NO: 13872 - RNA, 62 nt, Human
gggaggaggcccacaguucccuaaaacacccuuccggcgggagcaggggggaccccaacccc

SEQ ID NO: 13873 - RNA, 61 nt, Human
agcagaaccgaugagagccgcccuuaccguuggucuccggaucccccagucccaucccgcc

SEQ ID NO: 13874 - RNA, 62 nt, Human; identical to SEQ ID NO: 10558

SEQ ID NO: 13875 - RNA, 61 nt, Human
accguuuuucaagaaaacuggaaaucuggauuuucagcgaacaugccugauuuuaaaaggu

SEQ ID NO: 13876 - RNA, 62 nt, Human; identical to SEQ ID NO: 10491

SEQ ID NO: 13877 - RNA, 56 nt, Human
ucaccaagcaccacucgcucaucaaggcggagaucaugggagacguccugcacaag

SEQ ID NO: 13878 - RNA, 62 nt, Human
ucucuggaggacggucaguccaugucucggagaaacgggugagcugagcuuggcguuuggac

SEQ ID NO: 13879 - RNA, 62 nt, Human
ucuccugugaugucccaguuucccacucugaagaucccaacaugguccuagcacugcacacu

SEQ ID NO: 13880 - RNA, 62 nt, Human
aggcuccucacagaagggcccaggaaguccccgcccuugggacagccuccuccguagccccu

SEQ ID NO: 13881 - RNA, 59 nt, Human
cuagacagugucugccuuuccaggacauucuucuugguauuccuuaccugaagccuggu

SEQ ID NO: 13882 - RNA, 62 nt, Human
ucagaguaauucuuuuguacuuucaauacgauuuaauaucgaugcuuuuuaguccauuuugu

SEQ ID NO: 13883 - RNA, 62 nt, Human
caacauggugaaaccccgucucuacuaaaaauacaaaaaguagccaggcgugguggcgugug

SEQ ID NO: 13884 - RNA, 62 nt, Human; identical to SEQ ID NO: 13763

SEQ ID NO: 13885 - RNA, 62 nt, Human
agcuauagcaguacaaugauuaguaauguaaaaauuaacacagaaauuaaccuaaggaauga

SEQ ID NO: 13886 - RNA, 62 nt, Human
cgucgcucccuucauuuugggacugaggcugcagcauuggaacaaaagagcauuauuucaau

SEQ ID NO: 13887 - RNA, 62 nt, Human
gagacgucggacagggcggggguuggggaacucucggcuacagcaucuuacccuugacugag

SEQ ID NO: 13888 - RNA, 62 nt, Human
aaaaucgauccgcuuaccaugggccuauucuuguaaguuucaguuagcauuugcauguguaa

SEQ ID NO: 13889 - RNA, 54 nt, Human
agacaaugcccagaaucaaggagagcuaaguccaccauuccgucgagacuuaca

SEQ ID NO: 13890 - RNA, 62 nt, Human
uuaaguugagugaacaucggccaugaaaauccaucacgaauacuuuuggaucaauagucuau

SEQ ID NO: 13891 - RNA, 62 nt, Human
gcgcuccuccagccgcugcgcccgcuccagcuccuccgccgacgugaagacguugacguuga

SEQ ID NO: 13892 - RNA, 62 nt, Human; identical to SEQ ID NO: 12066

SEQ ID NO: 13893 - RNA, 62 nt, Human
aaaaaaaugcccaaguugcccuuuaaaaaaaaagagcguaaauacaaacaggaguggugcaa

SEQ ID NO: 13894 - RNA, 62 nt, Human
gagagcaggauccucuucagcaccuggaaccuggaucacauaauagaaaagaaacgcaccau

SEQ ID NO: 13895 - RNA, 61 nt, Human
acuuauuuccugggcuggugcgccccaaaacacggccccgacacuuaguguggccccaggc

SEQ ID NO: 13896 - RNA, 62 nt, Human
cuccuaugaggaugagcaaaaauacuacucucuucgcccugaguugcuuucuggaucugggg

SEQ ID NO: 13897 - RNA, 59 nt, Human
uucuaggacaugaauaugaccuacacugugcuaggcgcaaauguugcauuuaugaaaaa

SEQ ID NO: 13898 - RNA, 62 nt, Human
aucaccuuugggaaccugcugugagagugcugagguaccagaagugugagaacgagggggcg

SEQ ID NO: 13899 - RNA, 60 nt, Human; identical to SEQ ID NO: 12204

SEQ ID NO: 13900 - RNA, 62 nt, Human
ucaacccgacggaucacagugaaagggauuccucccacgccagaucugcacaacgaggcaag

SEQ ID NO: 13901 - RNA, 62 nt, Human; identical to SEQ ID NO: 9690

SEQ ID NO: 13902 - RNA, 62 nt, Human
ggcugaccuccugcacaacgucagccagaacaucgcggccgagacccgggcugaggacccgc

SEQ ID NO: 13903 - RNA, 60 nt, Human
uguuaucauuugucuuacaggcggcuauugcagacggcuaauuuaugcuuaacuuaggaa

SEQ ID NO: 13904 - RNA, 62 nt, Human; identical to SEQ ID NO: 9365

SEQ ID NO: 13905 - RNA, 59 nt, Human
gugcugggauuacaggugugagccaccacgcccggccgauuuggggcauuuuuauuuaa

SEQ ID NO: 13906 - RNA, 62 nt, Human; identical to SEQ ID NO: 9365

SEQ ID NO: 13907 - RNA, 59 nt, Human; identical to SEQ ID NO: 13905

SEQ ID NO: 13908 - RNA, 62 nt, Human
aucuuuccagucucauacuagugaaacuuuuaccacgacguaaaggaaauaccuggaaaacu

SEQ ID NO: 13909 - RNA, 62 nt, Human; identical to SEQ ID NO: 13023

SEQ ID NO: 13910 - RNA, 62 nt, Human
cuagugauaaucccaccacccuuugcugacucucuuuuugaacucagcccgccugcacccag

SEQ ID NO: 13911 - RNA, 62 nt, Human
cuugugcugagggaugauuugcuccugaccuugauuaacuuaacaguucccagcuggaaggg

SEQ ID NO: 13912 - RNA, 62 nt, Human
cauuucugaccgcuuuuucuugguuaugaaucuuaauuucgaauauaagaugauagguaagc

SEQ ID NO: 13913 - RNA, 62 nt, Human
ucuaauuuacagggauauuuaauuuugucaggucuauguauauuuauccagcuauacuuacu

SEQ ID NO: 13914 - RNA, 62 nt, Human; identical to SEQ ID NO: 12319

SEQ ID NO: 13915 - RNA, 62 nt, Human; identical to SEQ ID NO: 12708

SEQ ID NO: 13916 - RNA, 62 nt, Human; identical to SEQ ID NO: 12319

SEQ ID NO: 13917 - RNA, 62 nt, Human; identical to SEQ ID NO: 12320

SEQ ID NO: 13918 - RNA, 62 nt, Human
gaaaggauguuacuagaaguacacaaauugggcccggcgcgauggcucacgccuguaauccc

SEQ ID NO: 13919 - RNA, 62 nt, Human
acccaggaggaauugaaagaggcuuccucuucucaggaagaagccauuuccuucucauauag

SEQ ID NO: 13920 - RNA, 62 nt, Human
ucuaaucccacuguauuaagaggggaaaccgggccaagcgcaguggcucacaccucuaaucc

SEQ ID NO: 13921 - RNA, 61 nt, Human
ccccucccuagagccucugagguuugagagagagagcgggaggagggucuggcuuggggac

SEQ ID NO: 13922 - RNA, 62 nt, Human
gcauaauccacccccacucuagcuccaccuacacacgccggaccgcucgcucuccgcccauc

SEQ ID NO: 13923 - RNA, 60 nt, Human
ugugauuucuagcucagccucccaccgucuuccuccuacacaccaaugaugagccucaug

SEQ ID NO: 13924 - RNA, 62 nt, Human
aacugcugacgcgaaagaggcgcaguucccaauuaauacggaaaucgcugugggagaagaau

SEQ ID NO: 13925 - RNA, 61 nt, Human
augugagaaugccuucauuuaaaacuuuaugaagguaucgaaacauaacucauucuagaga

SEQ ID NO: 13926 - RNA, 62 nt, Human
gaaugaaccauuaaaugaaacaacagcaaaacauguucaggaauuuuauaaacuugaugagg

SEQ ID NO: 13927 - RNA, 61 nt, Human
auauuauaaagaugcucuacaugcacacucaauuacgcccacaccagccaugcaaaauuaa

SEQ ID NO: 13928 - RNA, 62 nt, Human; identical to SEQ ID NO: 11286

SEQ ID NO: 13929 - RNA, 61 nt, Human
aaacaucagccuaauggcucaugucaguaugagcagaaacauuucaaccaugagauaaacc

SEQ ID NO: 13930 - RNA, 62 nt, Human; identical to SEQ ID NO: 10015

SEQ ID NO: 13931 - RNA, 60 nt, Human
uuuucuaagugguaugugagauuuucuaauguaguuagaaguuucauugucugauggaca

SEQ ID NO: 13932 - RNA, 62 nt, Human
ggcugccauguggcuuauuaacagcuuccaguggaagucgcaauaaacaguuuuugguaaau

SEQ ID NO: 13933 - RNA, 62 nt, Human; identical to SEQ ID NO: 13121

SEQ ID NO: 13934 - RNA, 62 nt, Human
cugcuggcccggccucccuuccguccaggcagccgugcugcagacagaccuagugccgaggg

SEQ ID NO: 13935 - RNA, 62 nt, Human
uuucaguucaagugcucuucagcacugucuugucucccaauauaccaacccacuggcacauu

SEQ ID NO: 13936 - RNA, 62 nt, Human; identical to SEQ ID NO: 11692

SEQ ID NO: 13937 - RNA, 62 nt, Human
ccuggugaaugaugaauguugcugucaaagggcugcccccuaccuuauaaggguugcugggc

SEQ ID NO: 13938 - RNA, 62 nt, Human
gguggugucuaagaagucggacaccuugguuuuuguguuagauugagcugggcagcugcaau

SEQ ID NO: 13939 - RNA, 60 nt, Human
cggaugggcuuuaaauuauucccauaggggccaauuucaaauaauaauuuuuuucccuga

SEQ ID NO: 13940 - RNA, 62 nt, Human
uuuacuugacaggguuucaccauguuggcuaggauaguuucaccaggaucucuuggccucau

SEQ ID NO: 13941 - RNA, 60 nt, Human
gaggucugcagacggagggcagaggugguggaaggggccaggggccugcaggccuccccc

SEQ ID NO: 13942 - RNA, 62 nt, Human
ugaagaggugaagugaccaacccacucccucucuggggucgaagggggcagcaugcaggguc

SEQ ID NO: 13943 - RNA, 62 nt, Human
aaucgcaaagagacaccacucugggcagagcagagcaggguaugggguggggagagagggug

SEQ ID NO: 13944 - RNA, 62 nt, Human
cuguauuuuuuuauauucuauauauuagguaggucaaucuuaauuggucucaagaggaagaa

SEQ ID NO: 13945 - RNA, 61 nt, Human
uugacagccauaauuagggaggcaugaauuaugcggcuauaaugcagagcccuacaauuaa

SEQ ID NO: 13946 - RNA, 62 nt, Human
cuuacaaauuaugauguaaguuauccauuuggcuuuuuccuaacuagucuuaccaaacuuag

SEQ ID NO: 13947 - RNA, 62 nt, Human; identical to SEQ ID NO: 11772

SEQ ID NO: 13948 - RNA, 62 nt, Human
gaccggcccugcaggaggugguggagccgugaaggaggccgagcugcagcucuggcugcugc

SEQ ID NO: 13949 - RNA, 61 nt, Human
cgccgccucccauggcacgucgggaacaccggagccgccaacuuggagacuccuggucugu

SEQ ID NO: 13950 - RNA, 62 nt, Human; identical to SEQ ID NO: 13488

SEQ ID NO: 13951 - RNA, 56 nt, Human
ccccuuuuuugacccuuuugagauggaacuuucauaaaguuucuuggcaguaguuu

SEQ ID NO: 13952 - RNA, 62 nt, Human
ucgucucugugggugccgggugguccaggcuugcacugaagacgugccacggggaggcuccu

SEQ ID NO: 13953 - RNA, 62 nt, Human
uguagauaauggagaaauuuucuaucucugucccuauuuguauaagccaaggugaugcuggg

SEQ ID NO: 13954 - RNA, 62 nt, Human
cagggaacucuucuccucgcgggggacuugggauggccaucagaccuucuagggucuggcug

SEQ ID NO: 13955 - RNA, 62 nt, Human
cgcaggcacagcagcaaguugguccccgcggauccgccgcgacaugacagcccccucggcag

SEQ ID NO: 13956 - RNA, 62 nt, Human
ucuguguuugucauuucugacuggaaaacuucuuacuccauaccuuguucgauauggaggac

SEQ ID NO: 13957 - RNA, 62 nt, Human
gaaaauuaaguuacuuuugcaaaacagauaaucauaagaugaaucaguauguagcuuaacac

SEQ ID NO: 13958 - RNA, 62 nt, Human; identical to SEQ ID NO: 13771

SEQ ID NO: 13959 - RNA, 61 nt, Human
gcccaggcuggagcccaguggcgagaucuuggcucacuacaaccuccaccucccggguuca

SEQ ID NO: 13960 - RNA, 62 nt, Human
gacuuggugucaggacaaguccccuuucuuauucacgcuucaguuucucaucugcaacauga

SEQ ID NO: 13961 - RNA, 62 nt, Human
aucaccucaggccaggugcaguggcucacgccuaugaucccagcacuuugggaggcugaggc

SEQ ID NO: 13962 - RNA, 62 nt, Human; identical to SEQ ID NO: 9785

SEQ ID NO: 13963 - RNA, 62 nt, Human; identical to SEQ ID NO: 13270

SEQ ID NO: 13964 - RNA, 62 nt, Human
cugggagugggagggcagcacgggcgugaaggucggaggacagagaaaggucagcaggguca

SEQ ID NO: 13965 - RNA, 62 nt, Human
ugccaagcgccugguccuguccucuugagcugcccuugcccagcacugcacucuggaggugg

SEQ ID NO: 13966 - RNA, 62 nt, Human; identical to SEQ ID NO: 11619

SEQ ID NO: 13967 - RNA, 62 nt, Human
uuacaacugcagccagaacaauggcuggguggaucgcacguaaagcuugccacuaaaaauca

SEQ ID NO: 13968 - RNA, 62 nt, Human; identical to SEQ ID NO: 9945

SEQ ID NO: 13969 - RNA, 61 nt, Human
gcccaggagccaggugucagggagcacugcugagaguaucacaauaggaucugucacgggg

SEQ ID NO: 13970 - RNA, 62 nt, Human
acccccaggcaagcucgagggggccacaccgugucccagggagcccagccuauucccguugg

SEQ ID NO: 13971 - RNA, 62 nt, Human
agaagagccucuacugaaaaauauggaucaucacagauccaaacagaaaaaugggggcgaug

SEQ ID NO: 13972 - RNA, 62 nt, Human
cggggccccuguaacccuacucuccucucucccuggaccucagaggugacacccauugggcc

SEQ ID NO: 13973 - RNA, 55 nt, Human
ccuuuucccuggaaguguccaugccucaccugcaacccaugugguucucagacuu

SEQ ID NO: 13974 - RNA, 62 nt, Human
uccugugcuuggaugcuuuuuauaagaguugucauuguuggaaauucuuaaauaaaacugau

SEQ ID NO: 13975 - RNA, 59 nt, Human
gugacuuuagaauggaacugccggcccuggcaacugucacgugugcuagaagguucgau

SEQ ID NO: 13976 - RNA, 62 nt, Human
agccuuucagguaagcaaauuaaaguucaguuugcucaucgacauuuggucuggucccucau

SEQ ID NO: 13977 - RNA, 61 nt, Human
gaaacacaaucucagggacccgagcagcuccaaggacgagaggauacagcagacacaaccu

SEQ ID NO: 13978 - RNA, 62 nt, Human
ccuguuuugcacgauguaaaaacccugucuuuuugcacgauacagccaaaaguauuggcuga

SEQ ID NO: 13979 - RNA, 60 nt, Human
gagagaucacucaaaugauuuuuauaaugaaaugacaagaauaacccuuuugguaaccgu

SEQ ID NO: 13980 - RNA, 62 nt, Human
gggguugaguuuuggccuucauccuuguagaucccuuuccuauugauuucccaccuuccagu

SEQ ID NO: 13981 - RNA, 62 nt, Human
ucgggaguuccagaccagccuggccaacauggugaaacuccaucucuccuaaaaaaaaaaaa

SEQ ID NO: 13982 - RNA, 62 nt, Human
cuuucagauuugggaggaagccuaucagcgaguggcuaaugagcaggagauuuaugaagguu

SEQ ID NO: 13983 - RNA, 61 nt, Human
gccaggcagacugggggcaggacagccggaagcugagaccaaggcuccucacagaagggcc

SEQ ID NO: 13984 - RNA, 62 nt, Human
cacagccugucuccaaucagcaaguggucgugccuggcucuagagagcguggggagcugguc

SEQ ID NO: 13985 - RNA, 61 nt, Human
cgcagagggaagcgucagcgggcgcugcugggagcagaacagucccucacaccugggcccg

SEQ ID NO: 13986 - RNA, 62 nt, Human; identical to SEQ ID NO: 9860

SEQ ID NO: 13987 - RNA, 62 nt, Human
gugagucaccgcgccuggccaauguuguuguuguuuuuaagacagaauuucacucuuuguug

SEQ ID NO: 13988 - RNA, 62 nt, Human
uuagcccuacucuugggcccccaaguuagcagaguaaucaaagcuuccuaccguuuggccua

SEQ ID NO: 13989 - RNA, 60 nt, Human
acccaggaguggcuacgcugaguggggagccggugaaugauccgugcaggaguggggcuu

SEQ ID NO: 13990 - RNA, 62 nt, Human; identical to SEQ ID NO: 10258

SEQ ID NO: 13991 - RNA, 59 nt, Human
ccccacaggcucucaagucuucccaaggccagaaucgaaagaaaauuaaaauuugaaug

SEQ ID NO: 13992 - RNA, 62 nt, Human; identical to SEQ ID NO: 10920

SEQ ID NO: 13993 - RNA, 55 nt, Human
gagcugcagguaucucaccuggcagccguccaguacugcuggcuuccucuggagg

SEQ ID NO: 13994 - RNA, 62 nt, Human; identical to SEQ ID NO: 9630

SEQ ID NO: 13995 - RNA, 62 nt, Human
caccccggucacgcaugaaggcaaaagcaggucagaagcgaauacucugccauuaucucaaa

SEQ ID NO: 13996 - RNA, 62 nt, Human
guaucaacgcuaugaacgcaaggcugugauauggaaccagaaggcugucugaacuuuugaaa

SEQ ID NO: 13997 - RNA, 62 nt, Human
agaagaaaaugaggguuacaguaaccuguugucuuuauauaacuugcaacaaacuaauuuau

SEQ ID NO: 13998 - RNA, 62 nt, Human
aaaaaaaguagagaaaggagcugaacuccacucucgaugcuacuuacagaggacaucuguaa

SEQ ID NO: 13999 - RNA, 62 nt, Human
ugccaggcagacugggggcaggacagccggaagcugagaccaaggcuccucacagaagggcc

SEQ ID NO: 14000 - RNA, 62 nt, Human
ugggguuuucugugcccaugacuugggggcugcacccccacagcacccccacaauguaggaa

SEQ ID NO: 14001 - RNA, 62 nt, Human; identical to SEQ ID NO: 11745

SEQ ID NO: 14002 - RNA, 62 nt, Human; identical to SEQ ID NO: 12738

SEQ ID NO: 14003 - RNA, 60 nt, Human
ggcugugcgaucucuuggccugguccuugcagcuguggcagcagcaggcuccccagcggc

SEQ ID NO: 14004 - RNA, 62 nt, Human
auggaaaauguuuucugaaugcuuuauauucuuucugcuguaaauuaaaaaugaagaaaauu

SEQ ID NO: 14005 - RNA, 62 nt, Human; identical to SEQ ID NO: 9597

SEQ ID NO: 14006 - RNA, 62 nt, Human
uauccacugcuucacagagcaaaacauucaaucccauaaccaggcacaggggaacuaacuug

SEQ ID NO: 14007 - RNA, 60 nt, Human
auaauaaacuuuuuacagaaaauaugacagaaaacaacuauaaauaauagagcauaaagc

SEQ ID NO: 14008 - RNA, 62 nt, Human
agugguuacagucuagggcagugguucccaacucuccgaucagaaucaucugggaagcauuu

SEQ ID NO: 14009 - RNA, 62 nt, Human
ugggaagugugccugcccucgugugacauggaauuggugucaggaccgccacguggccuuca

SEQ ID NO: 14010 - RNA, 62 nt, Human
aguggagguugcacugagcugagaccauggaauugcacugcagcaugggcaacaagagucaa

SEQ ID NO: 14011 - RNA, 62 nt, Human
gccuugguucaucaguguuaaaaaauuuuugaaaaggcgguacuaguucagacacuuuggaa

SEQ ID NO: 14012 - RNA, 62 nt, Human
gaagggcgaguaggggcaccuggacgcugaugguggccaggaugcucagcuggccaggaggg

SEQ ID NO: 14013 - RNA, 62 nt, Human
ccaggggcagagccccugcuggauccugggagcucaucuuuaccugugccggagugggaacu

SEQ ID NO: 14014 - RNA, 62 nt, Human
uuauauuuuaauaaguccugaaucaaccugacuacggauauauggggccaccagggugcaug

SEQ ID NO: 14015 - RNA, 62 nt, Human
aaguuugcacuguaugcuggacggcauuccugcuuaucaauaaaccuguuuguuuuacacgu

SEQ ID NO: 14016 - RNA, 62 nt, Human
augucuucuuuauuguauuuuauuuaauuaaauaagugucgaaugagcuuucucuauagcca

SEQ ID NO: 14017 - RNA, 62 nt, Human
acugguucccaggcuggaaccagggucucucuuuaccuccuaccccaugguggcaccacaga

SEQ ID NO: 14018 - RNA, 62 nt, Human
ugcaaaaacugaacuucgggggucguucugugccuuccagcaucuuguacagcaaauccuga

SEQ ID NO: 14019 - RNA, 62 nt, Human; identical to SEQ ID NO: 11399

SEQ ID NO: 14020 - RNA, 62 nt, Human
accugccgcaaggagcagagacagcacagccccccgggcccagccgccucccucucuuggga

SEQ ID NO: 14021 - RNA, 61 nt, Human
augguaaccucacugccccgucacucccuucaaaggcgacagacccaagcccacgucagga

SEQ ID NO: 14022 - RNA, 62 nt, Human
cacugcucuuccccuccccccgcccccaagugugacuccagauggccaggguguacaccacc

SEQ ID NO: 14023 - RNA, 62 nt, Human
ugucuggugggggccacucaggagaguuggguuuucagggcagagaugggcuugauuccacc

SEQ ID NO: 14024 - RNA, 62 nt, Human; identical to SEQ ID NO: 10099

SEQ ID NO: 14025 - RNA, 62 nt, Human
acaaggugaugcagaugugaccuaggacgauggaccgccggacucuuuucugcagcacacgc

SEQ ID NO: 14026 - RNA, 62 nt, Human
gguugagugaggagugaaggauggggaggaggccucuggggaagggguucccucccuccuga

SEQ ID NO: 14027 - RNA, 62 nt, Human
ggaacaguguuggggcaggaagguggaugcuguugucauggagcugugggaguuggcacucu

SEQ ID NO: 14028 - RNA, 62 nt, Human; identical to SEQ ID NO: 10418

SEQ ID NO: 14029 - RNA, 62 nt, Human
gagcuaaugaacuagggagaaaaacuuuccaugugugcgguaucgucuuucagaaugucucc

SEQ ID NO: 14030 - RNA, 62 nt, Human
gugcucaggagacccguggggcacggaacaggagggucuggacccuguggcccagccaaagg

SEQ ID NO: 14031 - RNA, 62 nt, Human
ugcugggauuacaggcgugagccaccacucccggcuaaguuaguauuucuuuaaucuuaaug

SEQ ID NO: 14032 - RNA, 62 nt, Human
auaggcaugauaacaguguuaauagaccagugugauagaucacuuaucuuuauggauugugc

SEQ ID NO: 14033 - RNA, 62 nt, Human; identical to SEQ ID NO: 9345

SEQ ID NO: 14034 - RNA, 62 nt, Human
aaguagugcuguaaauauucugccauaggaauacugucuacaugcuuucucauucaagaauu

SEQ ID NO: 14035 - RNA, 62 nt, Human; identical to SEQ ID NO: 13504

SEQ ID NO: 14036 - RNA, 62 nt, Human
cagucugugccggggaaggcacugguuaggaaggauguucaaacggucccacccaagccugu

SEQ ID NO: 14037 - RNA, 62 nt, Human
gcauagauacggguauuuauuuuacccuaagaagauuuugaaguuuaaaaguacuuaaacua

SEQ ID NO: 14038 - RNA, 62 nt, Human
aggaagagaguguuagaaaggguaggacugagaaacagccuauaaucuccaaagaaagaaua

SEQ ID NO: 14039 - RNA, 59 nt, Human
aaauaagacgugaaguguaggaaaucaugaaaagaacaauuuugcaaauugcauucuga

SEQ ID NO: 14040 - RNA, 62 nt, Human
gcgucugcugcccuaggugugcuggaaguccacuuggaagaacuguuccggaggcgcugggu

SEQ ID NO: 14041 - RNA, 62 nt, Human
guaguuggcgcccaauggggggucccugagacuugcauguaaaacuagucuagaugucuucu

SEQ ID NO: 14042 - RNA, 62 nt, Human
accucuucaagacuuuugacuuagaaccugcuauauuaucaagcuuaccuacuguuaucucu

SEQ ID NO: 14043 - RNA, 60 nt, Human
caguguagacauguuuucaaauaaaacaaaugauuguguacaacaaugagucagacuuuu

SEQ ID NO: 14044 - RNA, 62 nt, Human; identical to SEQ ID NO: 10708

SEQ ID NO: 14045 - RNA, 61 nt, Human
agaagaugucaaauggagagccucaaacuguggccgacugacaugcgugcaucuuuugggg

SEQ ID NO: 14046 - RNA, 62 nt, Human
gcggguccucggcuccaugugccagaggcuccgguccaugcaguacaauggcagcuacuucg

SEQ ID NO: 14047 - RNA, 50 nt, Human
uuaggagaacauuuugcuaaagcaugacuaaacugcaaaaaaaaaaaaag

SEQ ID NO: 14048 - RNA, 62 nt, Human
gggggucuccacucaguccugcugccugcuucaccagaagcagcccugugaguguggggugg

SEQ ID NO: 14049 - RNA, 59 nt, Human
aaaaaagaaaacagauccugggagggggcgggaaauacaaggaauauuuuuuaaagagg

SEQ ID NO: 14050 - RNA, 62 nt, Human; identical to SEQ ID NO: 9233

SEQ ID NO: 14051 - RNA, 61 nt, Human
ucuauuuccuggcaccucccugccuguccuuggggauucuacuucuuccugugugggagcc

SEQ ID NO: 14052 - RNA, 62 nt, Human; identical to SEQ ID NO: 9715

SEQ ID NO: 14053 - RNA, 60 nt, Human
gcugccgagugaacccucugucccugagcuaacccacauacuagcagaggaggaagucag

SEQ ID NO: 14054 - RNA, 62 nt, Human; identical to SEQ ID NO: 11009

SEQ ID NO: 14055 - RNA, 62 nt, Human; identical to SEQ ID NO: 9792

SEQ ID NO: 14056 - RNA, 62 nt, Human
guccuuccaccugugagccaagcccccauuugaggacaucuaucguauucuugugugcuggg

SEQ ID NO: 14057 - RNA, 62 nt, Human
cuggacugacugcuggcuggcgaggaggcugcgagcguggaaucggaagcgaccgcgggcuu

SEQ ID NO: 14058 - RNA, 62 nt, Human; identical to SEQ ID NO: 12415

SEQ ID NO: 14059 - RNA, 62 nt, Human; identical to SEQ ID NO: 10638

SEQ ID NO: 14060 - RNA, 62 nt, Human; identical to SEQ ID NO: 10608

SEQ ID NO: 14061 - RNA, 56 nt, Human
uguuugccccucagcgugccaggcagacugggggcaggacagccggaagcugagac

SEQ ID NO: 14062 - RNA, 62 nt, Human; identical to SEQ ID NO: 11048

SEQ ID NO: 14063 - RNA, 62 nt, Human
gcucgagugcuuagaaacccccucuggugcuugguugaacaagggaaucacaagaaaacgaa

SEQ ID NO: 14064 - RNA, 62 nt, Human
accgugugugaaccugucaacucucugucgucuuuggagcgauacaguuguguuguuaaucu

SEQ ID NO: 14065 - RNA, 59 nt, Human
aggccgcgcagccgggucccuucuguguauuuuggacgaccuccuguggauaccagccg

SEQ ID NO: 14066 - RNA, 62 nt, Human
ugcaaaacaaaaaauuuuaaaagaaaaugugacuucaaaggaaaggaacaaauuuucaaaga

SEQ ID NO: 14067 - RNA, 55 nt, Human
guaaauauguauguagacacuuuuaaaagcacguauuuaugucccugacuguaaa

SEQ ID NO: 14068 - RNA, 62 nt, Human
ucaaagaaggguggaaguucuaaugucuguuagcuacccauaagaaugcuguuugcugcagu

SEQ ID NO: 14069 - RNA, 57 nt, Human
ccucaaaauaccauaguagcugcuugauaaaauucuaaaaauaucugguucucuauu

SEQ ID NO: 14070 - RNA, 62 nt, Human
ggcaccugguaucucgagugccugcaguugcaaguauguuuacaccugguguccaauuuugu

SEQ ID NO: 14071 - RNA, 60 nt, Human
aaaauuuuuuugccaauggugccaaguaaugugaaugcuaauacugcuuaagaaaauuaa

SEQ ID NO: 14072 - RNA, 62 nt, Human
aaaccccagcuauuuucugaccaaaauguguuucauaacaaaccaucuggugccuuuccaca

SEQ ID NO: 14073 - RNA, 56 nt, Human
gaaagggauuccucccacgccagaucugcacaacgaggcaagacaggacccaccug

SEQ ID NO: 14074 - RNA, 62 nt, Human
aaauugcuuugacuucuaaauguuucugcuucccagaaugcaccugacuuaugaaaugggga

SEQ ID NO: 14075 - RNA, 60 nt, Human
uguuucgaagugggaugacagucggccacggaaaacaagaggaagccucggccucccuga

SEQ ID NO: 14076 - RNA, 62 nt, Human
uucugcggaagcuggugaaagcucgcgucaucacugaucuaagcaguggcaucugagugggc

SEQ ID NO: 14077 - RNA, 59 nt, Human
ucccucagggcccacauguccugccacucgccacucugagcacgaguucaccuuccaga

SEQ ID NO: 14078 - RNA, 62 nt, Human
aaaagagggugcaagaaugugggaguaugucugccgguuucaacacacacagacaaacacag

SEQ ID NO: 14079 - RNA, 62 nt, Human
auccuggccaccaugggcaccaggacacagggauggauaccaccuacccucgccucuggaau

SEQ ID NO: 14080 - RNA, 62 nt, Human
uuuaguuuuguuuuguuuuguuuuuucuuuuagaacuguauaguauugaaaaagaaaucaaa

SEQ ID NO: 14081 - RNA, 61 nt, Human
uccugacucgugucuuuuuacccccaagauaucugucuucaguagcgacugaaucugccac

SEQ ID NO: 14082 - RNA, 62 nt, Human
uaccucacaggcccacccccugccgggcaugccgugggaucaugggcagggaaggcucuggg

SEQ ID NO: 14083 - RNA, 61 nt, Human
gucucuguucgcucgcuuaagcuguuuugaagccaagugaagagugugguuugcauccaag

SEQ ID NO: 14084 - RNA, 62 nt, Human; identical to SEQ ID NO: 14082

SEQ ID NO: 14085 - RNA, 61 nt, Human; identical to SEQ ID NO: 14083

SEQ ID NO: 14086 - RNA, 62 nt, Human
caugugcgcauuacacacacacaauacacauacaugcauauagacgcaucuauuggaaaugc

SEQ ID NO: 14087 - RNA, 61 nt, Human
guuccacacaguaaucugagcagugacucauggaaggaugaggaacguuugcuccagcuuc

SEQ ID NO: 14088 - RNA, 62 nt, Human; identical to SEQ ID NO: 11262

SEQ ID NO: 14089 - RNA, 58 nt, Human
uuucacuggccuggugacuggaaugugggcagcgcccacacaggcucuggcccauggc

SEQ ID NO: 14090 - RNA, 62 nt, Human; identical to SEQ ID NO: 10562

SEQ ID NO: 14091 - RNA, 56 nt, Human
uggcuuggauccgccaugcagagauguggccgggcacccaucuuccuucccuccuc

SEQ ID NO: 14092 - RNA, 62 nt, Human
aaauaagcuuuuaaacuggugucuuuggaaggaagguagauacaaaaagauugugguaaaaa

SEQ ID NO: 14093 - RNA, 60 nt, Human
ggaaggcgcucccucaucugggccaaaggaaggaggacgaagcccuccucagcuggccug

SEQ ID NO: 14094 - RNA, 62 nt, Human
gauugugguccccugcccccucugucccgucccccugcccaagugacugaaaccuacugagc

SEQ ID NO: 14095 - RNA, 60 nt, Human
ggagacguccugcacaagucccugcaacuggacgugcagaucgccucggagcacgccucc

SEQ ID NO: 14096 - RNA, 49 nt, Human
agccuggcgggcggagcuaagggccuccaccagcauccgagcaggauca

SEQ ID NO: 14097 - RNA, 53 nt, Human; identical to SEQ ID NO: 12995

SEQ ID NO: 14098 - RNA, 62 nt, Human
cuccccuccgccagagcugccuguggccagacacacgguggagggaagugcacgcgaaacag

SEQ ID NO: 14099 - RNA, 60 nt, Human
aacccccaucugaccagaaacaugccaauccugagaauaaccuccccuccagccagagau

SEQ ID NO: 14100 - RNA, 62 nt, Human
uuccuggcaaauaaauucccguuucuauccaaaagagcaauaaaaaguuuucagugaaaugu

SEQ ID NO: 14101 - RNA, 61 nt, Human; identical to SEQ ID NO: 11324

SEQ ID NO: 14102 - RNA, 62 nt, Human
ccucucucgucaccaaacuggaaccucacaccagccggcaaaggaaggaagaaagguuuuag

SEQ ID NO: 14103 - RNA, 61 nt, Human
uguuucaggugggucacauucugaugaauguuucccuuguacagaucccagcuuauggccu

SEQ ID NO: 14104 - RNA, 62 nt, Human
agaguaaaugacugucuuaucacucuuauuugacauuucguagguguaagagaaauggaaau

SEQ ID NO: 14105 - RNA, 61 nt, Human
ugucaccugaaacauaggugacauagcucaccaauguccuaaccgagacacaaacuccaca

SEQ ID NO: 14106 - RNA, 62 nt, Human
cucuggugcuugguugaacaagggaaucacaagaaaacgaaaaugcaaaaacugaacuucgg

SEQ ID NO: 14107 - RNA, 59 nt, Human
ggcuuucucggcacccagaagaaguggggagcgggcaaagcagaaaacauucaaugcau

SEQ ID NO: 14108 - RNA, 62 nt, Human
cgccaauacugugacuuccaaacaauguuacugcugggcacagcucugcguugcucccgugc

SEQ ID NO: 14109 - RNA, 62 nt, Human
ccccacgauuggccaccuguagccaucugcacacaccuccgagacaguccagugucaccucu

SEQ ID NO: 14110 - RNA, 62 nt, Human
aagguuuuuucuuuucuauggaguuauucuuuacauacaauauaguucauaaauuuuaaaua

SEQ ID NO: 14111 - RNA, 61 nt, Human
ccagagaggggaaccccacugguuuuuguggaaacaauggaaacuuacagaugccugccug

SEQ ID NO: 14112 - RNA, 62 nt, Human; identical to SEQ ID NO: 9933

SEQ ID NO: 14113 - RNA, 62 nt, Human; identical to SEQ ID NO: 11754

SEQ ID NO: 14114 - RNA, 62 nt, Human; identical to SEQ ID NO: 9933

SEQ ID NO: 14115 - RNA, 62 nt, Human; identical to SEQ ID NO: 11754

SEQ ID NO: 14116 - RNA, 62 nt, Human
uugaaaaaucccacccauguuguaccaccuuggugagucauaugccacucaucagcuuggga

SEQ ID NO: 14117 - RNA, 62 nt, Human
gaauauccucuauuaauacugaauuuagauaucuuuauuccauuuauuaugguacaaauaac

SEQ ID NO: 14118 - RNA, 62 nt, Human
aaagcguuacggggcgccugcaugcaggaggaaggaccuguauuagcuggaaaucaucagga

SEQ ID NO: 14119 - RNA, 61 nt, Human
gcucugcugcaggagagggggcuaaggggcuggauccaccaaggcagcucacagcgggaaa

SEQ ID NO: 14120 - RNA, 62 nt, Human
uguuucugguuuuuccuugccccugugugaaaauagguccuaaaugacugacuucacugcau

SEQ ID NO: 14121 - RNA, 56 nt, Human
ccaugagagcauauccuauccaacuuggacgcguuauggagacuggaagaccauuc

SEQ ID NO: 14122 - RNA, 62 nt, Human
guaggcauuaucaccaugcgacagguugaggaccgugaggcacgcuggaguuauuugacucg

SEQ ID NO: 14123 - RNA, 50 nt, Human
cugcagaagcuaagacauaggaauucuacagcaugauauuucagacuucc

SEQ ID NO: 14124 - RNA, 62 nt, Human
ucauguguugauuuuauuugaccccuggaguggugggucucaucuuucccaucucgccugag

SEQ ID NO: 14125 - RNA, 60 nt, Human
gucccgggaaggcaacuacccaaagacgccuggguugucaggcucaauccuugagccuca

SEQ ID NO: 14126 - RNA, 62 nt, Human
cgacccaagaccccccuacaagcauacuucuuuugcguauuauguuuaacucacaaaacaaa

SEQ ID NO: 14127 - RNA, 62 nt, Human; identical to SEQ ID NO: 13099

SEQ ID NO: 14128 - RNA, 62 nt, Human
gaagagaguguuagaaaggguaggacugagaaacagccuauaaucuccaaagaaagaauaag

SEQ ID NO: 14129 - RNA, 62 nt, Human
uccgaacggccucucagaagagccucuacugaaaaauauggaucaucacagauccaaacaga

SEQ ID NO: 14130 - RNA, 62 nt, Human
uucucccccgugccccuugaugcccccuccccacagugcucaggagacccguggggcacgga

SEQ ID NO: 14131 - RNA, 62 nt, Human; identical to SEQ ID NO: 13880

SEQ ID NO: 14132 - RNA, 62 nt, Human; identical to SEQ ID NO: 10009

SEQ ID NO: 14133 - RNA, 62 nt, Human
aaaaagaagagaaaaaaaaugcccaaguugcccuuuaaaaaaaaagagcguaaauacaaaca

SEQ ID NO: 14134 - RNA, 62 nt, Human
uucugcuuccuaaaucaguuuucuaaauuaugccugcaauuaggcauuggucaggggugaau

SEQ ID NO: 14135 - RNA, 62 nt, Human
agagugagacuguaccucuaaauaaccaaaaccuugauuacagccauggggugggggugggg

SEQ ID NO: 14136 - RNA, 62 nt, Human
ccaggcuuucucggcacccagaagaaguggggagcgggcaaagcagaaaacauucaaugcau

SEQ ID NO: 14137 - RNA, 62 nt, Human
ggggggcgggucgugucguguccuuuucucucuggcuaggcaggugugccgcaaauauuuga

SEQ ID NO: 14138 - RNA, 62 nt, Human; identical to SEQ ID NO: 10375

SEQ ID NO: 14139 - RNA, 62 nt, Human; identical to SEQ ID NO: 13065

SEQ ID NO: 14140 - RNA, 62 nt, Human
uacguuagaaaaugacagaugguagagacuuccauagaauuaagaggguucucauggagggg

SEQ ID NO: 14141 - RNA, 60 nt, Human
auugcccuuaaaauauggaaaauguuuucugaaugcuuuauauucuuucugcuguaaauu

SEQ ID NO: 14142 - RNA, 62 nt, Human
uccauugcuggaucuagcgacauucucuaacauucccauuuaggugaaauaaauaucaaaag

SEQ ID NO: 14143 - RNA, 55 nt, Human
agggugggagagcccagccauuaccauggagacaagaaggguuuuccacccugga

SEQ ID NO: 14144 - RNA, 62 nt, Human
ccagaccagccuggccaacauggugaaacuccaucucuccuaaaaaaaaaaaaaaaaaaaaa

SEQ ID NO: 14145 - RNA, 58 nt, Human
agcuuugacgccucugacacacuggcccugccccggcacugccugcugggcugggaca

SEQ ID NO: 14146 - RNA, 62 nt, Human
caccaggacacagcuuccauuucuuuaacgucuguucccuuaacaucgcugaaaugauuuac

SEQ ID NO: 14147 - RNA, 55 nt, Human
acucaugaagcauaccccggccucucaguucuugagggccuccccaccgcagcag

SEQ ID NO: 14148 - RNA, 62 nt, Human
gugaaggcguuugugaggucuuucuggucccagcaugaaauaaagccuuggccugggggccg

SEQ ID NO: 14149 - RNA, 62 nt, Human; identical to SEQ ID NO: 11629

SEQ ID NO: 14150 - RNA, 62 nt, Human; identical to SEQ ID NO: 13610

SEQ ID NO: 14151 - RNA, 59 nt, Human
uggggaucuuucaccuuuagggaucucagcacaauuagaaucguaaagugaauucuauc

SEQ ID NO: 14152 - RNA, 62 nt, Human
gacgcagcugaugccugccuugguuccuaccacucugguguagacagaggacuuuguccaag

SEQ ID NO: 14153 - RNA, 61 nt, Human
gccacccauuccuaggguuccuagucccgggaaggcaacuacccaaagacgccuggguugu

SEQ ID NO: 14154 - RNA, 62 nt, Human
agaggcguccugcucgcucuuccgcaccguccuucccgguuaauaaaaugcccuguacgcuu

SEQ ID NO: 14155 - RNA, 60 nt, Human
ccccaggcaagcucgagggggccacaccgugucccagggagcccagccuauucccguugg

SEQ ID NO: 14156 - RNA, 62 nt, Human
guauaccaaauguaaucuuuccaaugcuccaaugaauuuauacaugagauugauaugcaaua

SEQ ID NO: 14157 - RNA, 60 nt, Human
cugggguacuccuuucggccccccugguagagucucgggaguucacacaggguggcaaac

SEQ ID NO: 14158 - RNA, 62 nt, Human
ucuuucuauuccccagugaacugagguuuuuaccgauuuauagagcagucaaauccgaagug

SEQ ID NO: 14159 - RNA, 57 nt, Human
uggggucagugcucuuggugccuuuucuauaauuguacuuguuuuuuaauuacuucc

SEQ ID NO: 14160 - RNA, 62 nt, Human; identical to SEQ ID NO: 14056

SEQ ID NO: 14161 - RNA, 59 nt, Human
gccucagccucccgaguagcugggauuacaggcgccugacaccacgccccgcuaauuuu

SEQ ID NO: 14162 - RNA, 62 nt, Human
ugaguagcugggauuacaggcacaugccaccaugcucagcuaauuuuuguauuuuuaguaga

SEQ ID NO: 14163 - RNA, 61 nt, Human
cucgaaggagcagccugggcagccaucacaccacgaggacaggaagcaccagcacguuuca

SEQ ID NO: 14164 - RNA, 62 nt, Human
acguucauacaggcuucauucaaccuggcguuccccuccauaauuaagaugaaacauuccgg

SEQ ID NO: 14165 - RNA, 62 nt, Human; identical to SEQ ID NO: 13862

SEQ ID NO: 14166 - RNA, 62 nt, Human
uccaaaauuacagcuauuggugaagaagggauguccgcuauauucuuuaguggcaacuuaac

SEQ ID NO: 14167 - RNA, 62 nt, Human
gacaacaaaacccauaaugcauaaguggccuuuuugaaccaagacuuugcaaacugaucucu

SEQ ID NO: 14168 - RNA, 62 nt, Human
cgaguagcugcgacuacaggcgccggccagcaugccugucuaauuuuuguauuuuaguagag

SEQ ID NO: 14169 - RNA, 62 nt, Human; identical to SEQ ID NO: 12863

SEQ ID NO: 14170 - RNA, 62 nt, Human
uugcuuucuggaucccaggauuaaaacuaaccgugaccacuacuccaaacaaaacacaauau

SEQ ID NO: 14171 - RNA, 55 nt, Human
cacaggugauccuaacauaucaggccauggacucaggaccugcccggugaugcug

SEQ ID NO: 14172 - RNA, 62 nt, Human
ggguugagaccagcacucugugaaaccuugaaaugagaaguaaaggcagaugaaaagaaaga

SEQ ID NO: 14173 - RNA, 61 nt, Human
caaaagguacuaggauuagcugcaaucucuacuuucgaugaggaaaucccaguaagcuuuc

SEQ ID NO: 14174 - RNA, 62 nt, Human; identical to SEQ ID NO: 9704

SEQ ID NO: 14175 - RNA, 62 nt, Human; identical to SEQ ID NO: 9705

SEQ ID NO: 14176 - RNA, 62 nt, Human; identical to SEQ ID NO: 9704

SEQ ID NO: 14177 - RNA, 62 nt, Human; identical to SEQ ID NO: 9705

SEQ ID NO: 14178 - RNA, 62 nt, Human
cuuuuuauauuaaugacuauugaaagugguaauaaaaauuuauauuauaggcuucaauguuu

SEQ ID NO: 14179 - RNA, 62 nt, Human
accuuuuguuugucccauugguggcagaugugagcgacaucaggcgcuuccucagugcauuu

SEQ ID NO: 14180 - RNA, 62 nt, Human
agugagcaaccaugccuggcagcagagagaauuugagaguuagagagccacagcuaggccag

SEQ ID NO: 14181 - RNA, 62 nt, Human
ucucuggauucgaaguuuguauuguauucauaguuaaagggaaucggguacuuugcuuguug

SEQ ID NO: 14182 - RNA, 62 nt, Human
agugcuauuucucauaggcuguuucuugaaauuuuaaguuuauugcuuuaaaauggcagugu

SEQ ID NO: 14183 - RNA, 58 nt, Human
gggacaucgugaggauuaacacuugcuaauaucuguaacacaauuuguaaccucucag

SEQ ID NO: 14184 - RNA, 62 nt, Human; identical to SEQ ID NO: 11613

SEQ ID NO: 14185 - RNA, 61 nt, Human
acaaaaaauuuuaaaagaaaaugugacuucaaaggaaaggaacaaauuuucaaagacuugg

SEQ ID NO: 14186 - RNA, 62 nt, Human
auauguaccaaggauguuacaguaaacaggaugaacuauuuaaacccacuggguccugccac

SEQ ID NO: 14187 - RNA, 62 nt, Human
uaauguugucacuaauuaauugccauuacucccaguuaguuacccuugucauuuggcauuau

SEQ ID NO: 14188 - RNA, 62 nt, Human; identical to SEQ ID NO: 12309

SEQ ID NO: 14189 - RNA, 60 nt, Human
augccaguuuccuaauuccaucucacuggagauguuuaaaguuggccucuauccuaauga

SEQ ID NO: 14190 - RNA, 62 nt, Human
uuacaggcaugagccacugcaccugaccugcugaauuguuuauaauggcaagaaauaggaaa

SEQ ID NO: 14191 - RNA, 62 nt, Human; identical to SEQ ID NO: 10462

SEQ ID NO: 14192 - RNA, 60 nt, Human
uguguuggugaagcuggugcugugggggccacucacucgaaugacaccuggaggccuguu

SEQ ID NO: 14193 - RNA, 62 nt, Human
aauccuuucucugccacucuuugaggagaaucucaccauuuauuaugcacuguagaauacaa

SEQ ID NO: 14194 - RNA, 61 nt, Human
cugucccagauuuuaagugauauuccaaaagggacuuuacauuaaaggagaagcccccaag

SEQ ID NO: 14195 - RNA, 62 nt, Human
uuagcauuugcauguguaauauuaaaaugaaagagcuucuuacccagugcuguugcccuuuu

SEQ ID NO: 14196 - RNA, 61 nt, Human
caucuuccacaugccaggcccugcaaagugcuggggagauaccaugguuuuccuggagcug

SEQ ID NO: 14197 - RNA, 62 nt, Human
uuuuagccaugaagaaucuuucagucauaguacuaauaauuaaauuuucaguauuuaaaaag

SEQ ID NO: 14198 - RNA, 57 nt, Human
cuaagcauuuggaagacccaggcuacaaaauaagacauaguuccugcccuccaggcc

SEQ ID NO: 14199 - RNA, 62 nt, Human; identical to SEQ ID NO: 14178

SEQ ID NO: 14200 - RNA, 62 nt, Human
gcccuccgucgggccccugccugccuucuccccuccacgcaaggcugugcucuuccucuggu

SEQ ID NO: 14201 - RNA, 62 nt, Human
uuccucauuuuucuuaaauccaaguuggccguuuuauuaguauguuucaaauguguauuacc

SEQ ID NO: 14202 - RNA, 62 nt, Human
cuuuauuuaguuguuuauuuauuuaguuauuuaucuuauuuauugaggggugaggagugcca

SEQ ID NO: 14203 - RNA, 62 nt, Human; identical to SEQ ID NO: 14201

SEQ ID NO: 14204 - RNA, 62 nt, Human; identical to SEQ ID NO: 14202

SEQ ID NO: 14205 - RNA, 62 nt, Human
ccuuccccccaggaaacacauguucauuugugugaucauguauagaccucagaacggaagau

SEQ ID NO: 14206 - RNA, 61 nt, Human
ugguaaaaacuggggucagugcucuuggugccuuuucuauaauuguacuuguuuuuuaauu

SEQ ID NO: 14207 - RNA, 62 nt, Human; identical to SEQ ID NO: 12554

SEQ ID NO: 14208 - RNA, 61 nt, Human
uuuccaaacgugugauucacuugugaacaaaagucauucuaacaauugccuucagcgucac

SEQ ID NO: 14209 - RNA, 62 nt, Human
aaugauuuuuauaaugaaaugacaagaauaacccuuuugguaaccguauugacugcagaguc

SEQ ID NO: 14210 - RNA, 57 nt, Human
aauuuugcauugcuuugaaauuugagcucauuugcaaacccgagucugccugggaac

SEQ ID NO: 14211 - RNA, 62 nt, Human
uuauuuuagauuaugggaaauaauuuuuaaagguauugguuaaauaacguuuaaaaacaugu

SEQ ID NO: 14212 - RNA, 62 nt, Human
cuugguuaugaaucuuaauuucgaauauaagaugauagguaagcgcagcuuucuuggauaau

SEQ ID NO: 14213 - RNA, 62 nt, Human
acugugagggugggugcuggcugagccccuggggcagaaggaguggggcaggcggggucuuu

SEQ ID NO: 14214 - RNA, 62 nt, Human
caaguaacugugugggguucuaaugccaguuuccuaauuccaucucacuggagauguuuaaa

SEQ ID NO: 14215 - RNA, 62 nt, Human; identical to SEQ ID NO: 11037

SEQ ID NO: 14216 - RNA, 62 nt, Human
uuguuuauuuguuuuugagauggagucucuacuaaaaauacaaaaaauuagccaggcauggu

SEQ ID NO: 14217 - RNA, 62 nt, Human
uuguuuucuaguaagaaaaugcuaccuugcuguacauacuuauaaccuuguauuuggaaaug

SEQ ID NO: 14218 - RNA, 58 nt, Human
ccugagagacugcccagcuggagaggccuuccuuuacaaggccacgcgugcagcuguc

SEQ ID NO: 14219 - RNA, 62 nt, Human
aaaaugcagcagaaacuuacauuccaaccuuagagacucauagugagcacaaggaaaguuuu

SEQ ID NO: 14220 - RNA, 60 nt, Human
cagcggcccagggugggccagaccagcagcccaggaagcagcacacgcggccguggggag

SEQ ID NO: 14221 - RNA, 62 nt, Human; identical to SEQ ID NO: 11043

SEQ ID NO: 14222 - RNA, 61 nt, Human
aggugauccaccugccucagccucccaaagugcugagauuacaggggugagucaccgcgcc

SEQ ID NO: 14223 - RNA, 62 nt, Human
gaacuugaucauuaucuggcccaaauaugaagauaaacuauaacuuuggaguuuguuuccua

SEQ ID NO: 14224 - RNA, 60 nt, Human
uccuuccagcacuaacaauguccauugcuggaucuagcgacauucucuaacauucccauu

SEQ ID NO: 14225 - RNA, 62 nt, Human; identical to SEQ ID NO: 10106

SEQ ID NO: 14226 - RNA, 60 nt, Human
ugagugugugcgagugugugggcuggugugugaauaucuauaaauaaguauauauggugu

SEQ ID NO: 14227 - RNA, 62 nt, Human
accacuuuuaauuguuacucauuuuauucacuaagcucgauaaaucuaacaguuacucuuaa

SEQ ID NO: 14228 - RNA, 62 nt, Human
augguggugcccuccuguggucccagcuacucgggagucugaggugggaggaucaccugagc

SEQ ID NO: 14229 - RNA, 62 nt, Human
agcucaagcccgcugguggcagggcguuuucccaccgggauacgggaagccaccugugucag

SEQ ID NO: 14230 - RNA, 62 nt, Human
ucuugacuggaugaguccuggcagucuuucuaggcgaaccaagaauguuugugugagggaag

SEQ ID NO: 14231 - RNA, 62 nt, Human
ggcaccugcccuauugcaaaggaauccaguuccuccggaauaacagucccacuguuaaccug

SEQ ID NO: 14232 - RNA, 62 nt, Human; identical to SEQ ID NO: 14230

SEQ ID NO: 14233 - RNA, 62 nt, Human
cacccgcccccaccaugcguccugcucucagacucagaauuaaaccccgguguuggcacugu

SEQ ID NO: 14234 - RNA, 62 nt, Human
gagcccaggggacucagugcccuccaugcccuggcuggcagaaacccucaacagcagucugg

SEQ ID NO: 14235 - RNA, 62 nt, Human
ucgaggcuggcccugccaggcaguuuucccggcguuuuaggaucuguacauagagaaauauu

SEQ ID NO: 14236 - RNA, 62 nt, Human
aacuuacccacuguaaucaccuaaauaaaguguuuauaaacaugauuguggcaccugugcuc

SEQ ID NO: 14237 - RNA, 62 nt, Human
aauucccagguuacgucugaggaucaguugguguaaagcugagauguuuuuucuugguucug

SEQ ID NO: 14238 - RNA, 58 nt, Human
accuaccaguacaacugugaauccuaggcaaggcaaaaaugcacuuccacugaaacga

SEQ ID NO: 14239 - RNA, 62 nt, Human
aaagucagucaaagcgcuggugaucccugcuccgcgugcguagcagugucugugccucuccu

SEQ ID NO: 14240 - RNA, 61 nt, Human
uuguaugaguuuggagcagugcugaaggccaaagccgccuacugguuuguaguuaaccuag

SEQ ID NO: 14241 - RNA, 62 nt, Human
cagagcgagacuccaucuaccagauccuuaugacgcagcugaugccugccuugguuccuacc

SEQ ID NO: 14242 - RNA, 62 nt, Human
gaagagaugccuugcgguguggccagcugugaggagaaagcagcuggcaguguuaggacauu

SEQ ID NO: 14243 - RNA, 62 nt, Human
uucaagaucuucccaauacauuucuucucauccuggagcguauuagcagugucagcguauuu

SEQ ID NO: 14244 - RNA, 62 nt, Human
ggaacuugaagacauacagcagcaucccuuagcaaugugacauugcuuuucagacuguuuuc

SEQ ID NO: 14245 - RNA, 62 nt, Human
ccaggugggguuagguucccagaggacugagggaauccuguacaggaugucccaggguagau

SEQ ID NO: 14246 - RNA, 61 nt, Human
uugaggugaauaaagcugcaugggaauuugcuuucgugauauauuucauuugcaaacuucu

SEQ ID NO: 14247 - RNA, 62 nt, Human; identical to SEQ ID NO: 12554

SEQ ID NO: 14248 - RNA, 60 nt, Human
augcccaaguugcccuuuaaaaaaaaagagcguaaauacaaacaggaguggugcaagccg

SEQ ID NO: 14249 - RNA, 62 nt, Human
cagggccagccucuccucugcugagaauccccacuugguguagggggagaggggaaaggggu

SEQ ID NO: 14250 - RNA, 59 nt, Human
guuuggaaagucuuugcuuuggaagcgucagacauuagaacaggccaaacuggacuguc

SEQ ID NO: 14251 - RNA, 62 nt, Human
guaaaguugaauuucuaggaaacgugccuuuguuuuuuaauaugcacuccaaauuagaaggc

SEQ ID NO: 14252 - RNA, 62 nt, Human
ugccccugcccccuggcccccacucccccggcuccguguaaaauaaauguuccagcccaacc

SEQ ID NO: 14253 - RNA, 62 nt, Human; identical to SEQ ID NO: 10220

SEQ ID NO: 14254 - RNA, 62 nt, Human
caugccgugggaucaugggcagggaaggcucugggggucggagacaccgcugcuuagcaccc

SEQ ID NO: 14255 - RNA, 62 nt, Human
agcgacagcuauggacagcaugguaccaaggaguuaaguugaggcuuuuuccagcuuucucu

SEQ ID NO: 14256 - RNA, 58 nt, Human
guaugguggugcccuccuguggucccagcuacucgggagucugaggugggaggaucac

SEQ ID NO: 14257 - RNA, 62 nt, Human; identical to SEQ ID NO: 9805

SEQ ID NO: 14258 - RNA, 60 nt, Human
caggcuggucucaaacuccugaccucaggugauccgcccaccucagccucccaaagugcu

SEQ ID NO: 14259 - RNA, 62 nt, Human
ugcuugauaaaauucuaaaaauaucugguucucuauuauguaaacacuauuacagucaccag

SEQ ID NO: 14260 - RNA, 61 nt, Human
guuguauacauuucuuauuuacgauuuucauuuguuauauauauauauaaauauacuguau

SEQ ID NO: 14261 - RNA, 62 nt, Human
uucugaaacugcauaagugaaaaucuuacaacaggcuuaugaauauauuuaagcaacaucuu

SEQ ID NO: 14262 - RNA, 60 nt, Human
agcugccguucauguguuggaggccaaauguggcaaaccaaccccaggcccacccagagc

SEQ ID NO: 14263 - RNA, 62 nt, Human
cgguucuccaggccgccgucagcagcucaaggugggguaugagugagaagcugaggaucucg

SEQ ID NO: 14264 - RNA, 55 nt, Human
auuuuguucccaucaguuuagcccagagauagacaguagaaugcaaauaccuccc

SEQ ID NO: 14265 - RNA, 62 nt, Human
gggcucuccggcaggcagcccgagaccugcacagaugaaggagcagagguucugaccgagag

SEQ ID NO: 14266 - RNA, 54 nt, Human
caccuuccuguucccuuuccugcccuuucggucaggcugccgacccgcccccca

SEQ ID NO: 14267 - RNA, 62 nt, Human; identical to SEQ ID NO: 10138

SEQ ID NO: 14268 - RNA, 60 nt, Human
gaggcuccuuuuuucuuuccuuugcaccagcuucccgauacuucuuggugugcaagagga

SEQ ID NO: 14269 - RNA, 62 nt, Human
gagaggcugagccaggaggaucgcuugagcccaggaggcggagguugcagugagcugagaug

SEQ ID NO: 14270 - RNA, 62 nt, Human; identical to SEQ ID NO: 12163

SEQ ID NO: 14271 - RNA, 62 nt, Human; identical to SEQ ID NO: 10254

SEQ ID NO: 14272 - RNA, 58 nt, Human
ccagccgauguguccucaucucaggcccgugccugggaccccgugucugcccaggugg

SEQ ID NO: 14273 - RNA, 62 nt, Human; identical to SEQ ID NO: 9967

SEQ ID NO: 14274 - RNA, 62 nt, Human
ggaggccucuggggaagggguucccucccuccugaagaugaacacacaauacacggaagagc

SEQ ID NO: 14275 - RNA, 62 nt, Human; identical to SEQ ID NO: 13872

SEQ ID NO: 14276 - RNA, 59 nt, Human
uuugccagcugcagugagauucugcagcauaggccacgauaaaggaaggagagaagggg

SEQ ID NO: 14277 - RNA, 62 nt, Human
gggagagcagagcucgccccugcacugcagccuugugggggagggcaaggcucuccucccag

SEQ ID NO: 14278 - RNA, 60 nt, Human
ugcuucaccagaagcagcccugugagugugggguggggaagucccuucccaacggagguc

SEQ ID NO: 14279 - RNA, 62 nt, Human
guagagacaggguuucaccauguugcccaggcuggucucgaacuccugagcucaggcagucu

SEQ ID NO: 14280 - RNA, 62 nt, Human
guucagugacggccaugcagguggccguccaaagacagccaacggagcugccucgcagaauc

SEQ ID NO: 14281 - RNA, 62 nt, Human; identical to SEQ ID NO: 11302

SEQ ID NO: 14282 - RNA, 60 nt, Human
ggggcucuccgugguguucuggacccagccccuggagacaccauucacuuuuacugcuuu

SEQ ID NO: 14283 - RNA, 62 nt, Human
uauacgaacaaaacacacgcgcgcacacacacacauacacgaaagagagagaaacaaacuuu

SEQ ID NO: 14284 - RNA, 61 nt, Human
cucagcugcagggaggcagaaggcaaggcaggccccacggacacacuugggcugcucugaa

SEQ ID NO: 14285 - RNA, 62 nt, Human
uacccccaccccccaccagccgcacagauuguacuaccgcgagaggcaucccuggcgcuguc

SEQ ID NO: 14286 - RNA, 60 nt, Human
ucuccaagcgccuggcuuuggaaugcuccaggcgcgccgacgccugugccaccccuuccu

SEQ ID NO: 14287 - RNA, 62 nt, Human
accgagaccucaccaagcaccacucgcucaucaaggcggagaucaugggagacguccugcac

SEQ ID NO: 14288 - RNA, 55 nt, Human
cccaggucagugcuccucaaaccugaacaugcuaagagucaccuggagguccagu

SEQ ID NO: 14289 - RNA, 62 nt, Human
aggacccgccgugguuugaaggcuuggagucccgauuucagagcaagucuggcuaucugaga

SEQ ID NO: 14290 - RNA, 62 nt, Human; identical to SEQ ID NO: 14140

SEQ ID NO: 14291 - RNA, 62 nt, Human
accaacaacacugucugccucagaacauagccgugaucaagaugagcacggaggcucguguc

SEQ ID NO: 14292 - RNA, 61 nt, Human
ggcguuuuugagaguggaaaagaaauuuaaacuucccgaaagaagguccaccaucaggaga

SEQ ID NO: 14293 - RNA, 62 nt, Human
uaguuggcgcccaauggggggucccugagacuugcauguaaaacuagucuagaugucuucuu

SEQ ID NO: 14294 - RNA, 62 nt, Human
cuaccaugucagaauauuuuuuccucacuccugacaaugcaaaaauggucuucaaagcacau

SEQ ID NO: 14295 - RNA, 62 nt, Human
aaaaguauaaaguaacacggaggaccacugugaacguaaguauagggcugcaucuugguuuu

SEQ ID NO: 14296 - RNA, 62 nt, Human
caggcaugagccaccucacuuggcccaauuuuaacuuaauuaucucugucaagagccuaucu

SEQ ID NO: 14297 - RNA, 62 nt, Human; identical to SEQ ID NO: 13625

SEQ ID NO: 14298 - RNA, 60 nt, Human
ggaaagggaagaaugcucaagcaagucauguuuguuuucagugggaugggcccgcguucu

SEQ ID NO: 14299 - RNA, 62 nt, Human
uaagaaaaugaaauauucuaugccuaauacucacacgcaacauuucuuguacuuuguaaguc

SEQ ID NO: 14300 - RNA, 62 nt, Human
uccaauugauaucaauacuuaggaagaccacagcuagacggacaaacagcauugggaggccu

SEQ ID NO: 14301 - RNA, 62 nt, Human
gcagaaaaugcuuagccugaguuucauaggagguaaucaccagacaacugcagaauguagaa

SEQ ID NO: 14302 - RNA, 58 nt, Human
guggcuugccugugccucuggguggauuacauaugauaguaaagcccaccuguuugga

SEQ ID NO: 14303 - RNA, 62 nt, Human; identical to SEQ ID NO: 13386

SEQ ID NO: 14304 - RNA, 61 nt, Human
agcgcuugccuagguugcugaaaacagggaggcaccugguaucucgagugccugcaguugc

SEQ ID NO: 14305 - RNA, 62 nt, Human
ucagcaagaagggacuguuucuaggugggcugggcgcgagcagggacugucccgagcgguau

SEQ ID NO: 14306 - RNA, 61 nt, Human
agcgcuguccccacggguaccaggaagugcagagccgcacaggagcugccccggagcugag

SEQ ID NO: 14307 - RNA, 62 nt, Human
acauuggaauuggaagaacuauaaagugugauucgaucgucaagacaucacuuggauuucuu

SEQ ID NO: 14308 - RNA, 61 nt, Human
cuucccauccgccauauuucuucagccuuucuucucgaucacccguguauucuuugaccag

SEQ ID NO: 14309 - RNA, 62 nt, Human; identical to SEQ ID NO: 10997

SEQ ID NO: 14310 - RNA, 61 nt, Human
gggaccccacacagcaauacgaguccaacuuaauaaacacauuucugggguuccucaggcu

SEQ ID NO: 14311 - RNA, 62 nt, Human
uuacacugcacucugacccuguaguacagcaauaaccgucuaauaaagagccuacccccaac

SEQ ID NO: 14312 - RNA, 58 nt, Human
agaauuugguuuucaaguacaaaacuuuuuguccuguaagauauaugcagccucacag

SEQ ID NO: 14313 - RNA, 57 nt, Human
uccagguggagacgcgaugaccucuacccuggcgcuaucuccaccacuguccaaaga

SEQ ID NO: 14314 - RNA, 53 nt, Human
uuuuuacauuuguuguacaaucaggaaaagcaauaaagauuuuucaaaaauag

SEQ ID NO: 14315 - RNA, 62 nt, Human
cccagggccguugccugcucagaccuugcaggcuguggagcaagaggcccugggucucucca

SEQ ID NO: 14316 - RNA, 61 nt, Human
acugaaucuauacuuugcagcacugucugaugcgucaacaaaauugagccauuuuuuuaaa

SEQ ID NO: 14317 - RNA, 62 nt, Human; identical to SEQ ID NO: 9280

SEQ ID NO: 14318 - RNA, 60 nt, Human
cuaccucacaggcccacccccugccgggcaugccgugggaucaugggcagggaaggcucu

SEQ ID NO: 14319 - RNA, 62 nt, Human; identical to SEQ ID NO: 13663

SEQ ID NO: 14320 - RNA, 59 nt, Human
ccagugaccacugaaagguaugugcuaugauaaagcagauggccuauuugaggaagagg

SEQ ID NO: 14321 - RNA, 62 nt, Human; identical to SEQ ID NO: 11235

SEQ ID NO: 14322 - RNA, 62 nt, Human
aagacccuugucugcaguggugcuccugcaggcugcccguuaagaugguggcggcacacgcu

SEQ ID NO: 14323 - RNA, 62 nt, Human
cacuaggcuugauugcaucccuguugugcccuuuaagagacauguuuccaccccacccccaa

SEQ ID NO: 14324 - RNA, 60 nt, Human
cuucuaucugugcacuuagcugggaacuuacccacuguaaucaccuaaauaaaguguuua

SEQ ID NO: 14325 - RNA, 62 nt, Human
gacugugugugaacugccagcagcuguagccaccugcucacagccucucugagaacccccug

SEQ ID NO: 14326 - RNA, 60 nt, Human
gagggcaaacagccaggacgcauuggagaggaauuugccaaagaucuacccugagauaac

SEQ ID NO: 14327 - RNA, 62 nt, Human
ucaaccucccagcuggugccacucugcccucgggggcuccaagcauuguaacucagucaugg

SEQ ID NO: 14328 - RNA, 56 nt, Human
aacgcucaugacagcaaagucuccaauguucgcgcaggcacuggagucagagaaaa

SEQ ID NO: 14329 - RNA, 62 nt, Human
gagggaagaaggggagauggaguggugagggcgagucaaauaaaaggauuugagugucucgu

SEQ ID NO: 14330 - RNA, 60 nt, Human
caccaggcugccucugcucuuggaaaacuaggaaaggggaucagaaacauccucuccccg

SEQ ID NO: 14331 - RNA, 62 nt, Human
caggcccagcugccuuuggcuuugaucucaagucaggcugaaggcagcgaagccucggggcc

SEQ ID NO: 14332 - RNA, 58 nt, Human
gggcucauuuucuacgucauguauuuuaugauacuugaauuuuuugaaaugggcauuu

SEQ ID NO: 14333 - RNA, 62 nt, Human
agucccccuccuaacgucuuccuuucccugcacuaacgccaaccugacugcuuuuccuguca

SEQ ID NO: 14334 - RNA, 61 nt, Human
auuaaugguuuguggaauccauuaugaagugcaauuagauagauguagguuccugccguuu

SEQ ID NO: 14335 - RNA, 62 nt, Human
cacauuuuccccucuugaagaaagguugcaagaagaacuaaauuauccucaaaagauuucug

SEQ ID NO: 14336 - RNA, 60 nt, Human
auuuuuuaauacacguaaucuuuuugaagcagacauuguauacagaaucuuacuucucuu

SEQ ID NO: 14337 - RNA, 62 nt, Human
uacuuaguuugaaauggugcaggcuuagucuuaagccuccaaaggccuggauuugagcagcu

SEQ ID NO: 14338 - RNA, 60 nt, Human
aguucaccagugagcucaggugucucaaagaaggguggaaguucuaaugucuguuagcua

SEQ ID NO: 14339 - RNA, 62 nt, Human; identical to SEQ ID NO: 12206

SEQ ID NO: 14340 - RNA, 59 nt, Human
caauuguaugugugauuauggaguuuugaaaacguuacauuuuuuaaaucuuaaaacug

SEQ ID NO: 14341 - RNA, 62 nt, Human
cuugaauuuuuugaaaugggcauuuauuuuauaacauguuaaaauguacuuuuuaaauuaag

SEQ ID NO: 14342 - RNA, 52 nt, Human
uuucccggcguuuuaggaucuguacauagagaaauauuuaaauuuuuagaag

SEQ ID NO: 14343 - RNA, 62 nt, Human
ggagccguucuccccacaagacaccacaugacaagggguauaagccccagcccugcucauuc

SEQ ID NO: 14344 - RNA, 60 nt, Human
cauggucaggucucacccugcuugaagcgcagaaggcacagccuuacugaccagcacgcc

SEQ ID NO: 14345 - RNA, 62 nt, Human
cuuuccaagcaaucucacguuuacugguuguucugggaguaaguggcuaaauguauauuuug

SEQ ID NO: 14346 - RNA, 59 nt, Human
ucaacacauuuuuaaaugacuaacuucuaaaagccccaacacaugacgccaucugaaga

SEQ ID NO: 14347 - RNA, 62 nt, Human; identical to SEQ ID NO: 11621

SEQ ID NO: 14348 - RNA, 61 nt, Human
gccucggccucccugagcucugaccccagccucacccgaaaggccagccuggggcucuccg

SEQ ID NO: 14349 - RNA, 62 nt, Human
uggcaaggaacauuugcaugugcucuuucauuugacuuuauagcagaccugggggaggagag

SEQ ID NO: 14350 - RNA, 59 nt, Human
augauaacaauuaaaaggauauucuguggaugucacguauuuugaaaugauagaacuac

SEQ ID NO: 14351 - RNA, 62 nt, Human
uuuugcuauguuaaaaguggcagaacaggaaagacgaauuaaaaauaacauuuuuuaagcga

SEQ ID NO: 14352 - RNA, 60 nt, Human
cggccagcgucuacgacggcaaguaccugccugcggccaacaugauggcugggcugagca

SEQ ID NO: 14353 - RNA, 62 nt, Human
auucuuguaaguuucaguuagcauuugcauguguaauauuaaaaugaaagagcuucuuaccc

SEQ ID NO: 14354 - RNA, 53 nt, Human
cccaagggggagguucgguagagaaaaauaguaagcugguuuagaaacugacg

SEQ ID NO: 14355 - RNA, 62 nt, Human; identical to SEQ ID NO: 12502

SEQ ID NO: 14356 - RNA, 62 nt, Human
cccauccccacccccagccccagcccaguccuccuaggagcaggacccgaugaagcgggcgg

SEQ ID NO: 14357 - RNA, 62 nt, Human; identical to SEQ ID NO: 10619

SEQ ID NO: 14358 - RNA, 55 nt, Human
guggugcaggcgguggagggacacaggccagcucaagcccgcugguggcagggcg

SEQ ID NO: 14359 - RNA, 62 nt, Human
uucuuaggcaaauucagagaaauaagugcuaguuaauacuaaucaccuccuccucugucucu

SEQ ID NO: 14360 - RNA, 60 nt, Human
uuuccaguuucccuugaucuagaugggauucuuauaaaaauucaaccucagacauaaaca

SEQ ID NO: 14361 - RNA, 62 nt, Human
uaaucugaauucccaagugccaggaguaggauuucauuauaaaauuaauagcuaaucuuauu

SEQ ID NO: 14362 - RNA, 60 nt, Human
cggauuuuuuuuuuaacuuucuucuuccuguuaaaacauaggucacuaacugugauguua

SEQ ID NO: 14363 - RNA, 62 nt, Human; identical to SEQ ID NO: 10075

SEQ ID NO: 14364 - RNA, 60 nt, Human
cuuaggcaaauucagagaaauaagugcuaguuaauacuaaucaccuccuccucugucucu

SEQ ID NO: 14365 - RNA, 62 nt, Human
cuccccagcggcccagggugggccagaccagcagcccaggaagcagcacacgcggccguggg

SEQ ID NO: 14366 - RNA, 61 nt, Human; identical to SEQ ID NO: 13969

SEQ ID NO: 14367 - RNA, 62 nt, Human
cugaagccacccccaccccucgccagcuagcuccauagggaagccugugucuccugccccca

SEQ ID NO: 14368 - RNA, 60 nt, Human
uuucugaagcguuuguguguguguugaucagguugugugauauuuuugcuugauagagaa

SEQ ID NO: 14369 - RNA, 62 nt, Human
ugagaccagccuggccaaauggugaaaccccaucucuacgaaaaauacaaaauuuagccggg

SEQ ID NO: 14370 - RNA, 60 nt, Human
aggcuuuuaugaggaaagcguuucuguguagaaacuggaagcuguucagggcaucggcag

SEQ ID NO: 14371 - RNA, 62 nt, Human
uagaggcugcagcuugagcuacaaucaggagggaaauuggaaggauuagcagcuuuuaaaaa

SEQ ID NO: 14372 - RNA, 59 nt, Human
uccccaugagcgucugcaaaacacuugccugaauacauaucacguauuuuagacucgaa

SEQ ID NO: 14373 - RNA, 62 nt, Human
agaagucccugauuccuucuuaaacuuggaaugauagaugaaauucacaccccugcagauca

SEQ ID NO: 14374 - RNA, 60 nt, Human
gcuuuguagugacucgugcucuccaaccugucuuccugaaaaaccaaggcccccuucccc

SEQ ID NO: 14375 - RNA, 62 nt, Human; identical to SEQ ID NO: 12597

SEQ ID NO: 14376 - RNA, 61 nt, Human
aauuagaaucguaaagugaauucuaucuauuuaauuggauauuggacucugcucauauaag

SEQ ID NO: 14377 - RNA, 62 nt, Human
gcccuugucucuggucagcccuggagcaugggaucgugggaaagaggagggggaccaggccc

SEQ ID NO: 14378 - RNA, 57 nt, Human
ugcaggcccggccuuuccccacgcggacuccgcgcgaccccggcccucucccugcgg

SEQ ID NO: 14379 - RNA, 62 nt, Human
uuuaauuggauauuggacucugcucauauaagcuacagacaaaagccaaaagacucucgcug

SEQ ID NO: 14380 - RNA, 59 nt, Human
uguucccaaauccagcuggccccaccagcucagauuccauuuuuuuugugugugugugu

SEQ ID NO: 14381 - RNA, 62 nt, Human
aguggaaaugauaacaccugccucauuggggcacuauaacaagugaaggacuuaggaaaaca

SEQ ID NO: 14382 - RNA, 62 nt, Human
uuaaaaaucaaaaaaugacuugcaaauuguuuuuuaaaaguaauuuugcauugcuuugaaau

SEQ ID NO: 14383 - RNA, 62 nt, Human
ccuuuuuucuucacauaaaguaguugauuacgagggagucaaauuuucuuuuuaaaaaggag

SEQ ID NO: 14384 - RNA, 61 nt, Human
ggggaggaaaggcuaaagcugcuggcccggggcccacaggaggggcuucgaggcuggcccu

SEQ ID NO: 14385 - RNA, 62 nt, Human
aaucucuguggggcgaugcugcagcggcugaaaccacgucaagucccccagagcccggcauu

SEQ ID NO: 14386 - RNA, 61 nt, Human
gcugaguuuucacccguaggaccugaauauagaugagcguauccucaguuaaccuacaccc

SEQ ID NO: 14387 - RNA, 62 nt, Human
uccggcuuucucugaaaugaacacugcucuucagcaguucaaguacuuguucucaaaacauu

SEQ ID NO: 14388 - RNA, 60 nt, Human
gggcacguggaggaagggucugaaggaaggcuccggagcacaggcccugguguuccugug

SEQ ID NO: 14389 - RNA, 62 nt, Human
ccgggaggcggagguuguugcagugagccgagaucgcgccaaugcacuccagccugggcuac

SEQ ID NO: 14390 - RNA, 59 nt, Human; identical to SEQ ID NO: 12676

SEQ ID NO: 14391 - RNA, 62 nt, Human; identical to SEQ ID NO: 9829

SEQ ID NO: 14392 - RNA, 54 nt, Human
auuuggccucuccagaagcagaagaguaucacgaucugacugcauuuuaaacaa

SEQ ID NO: 14393 - RNA, 62 nt, Human
uuccgauagagucgcuauuucugguuaauauacauauauaaauauauaaauacaaacacaca

SEQ ID NO: 14394 - RNA, 61 nt, Human; identical to SEQ ID NO: 13817

SEQ ID NO: 14395 - RNA, 62 nt, Human; identical to SEQ ID NO: 12176

SEQ ID NO: 14396 - RNA, 57 nt, Human
cuucacggaaggaagaucacauguccccagagaggcacccccaggcaagcucgaggg

SEQ ID NO: 14397 - RNA, 62 nt, Human
aaacuucuuacuccauaccuuguucgauauggaggacaaauaauuggauugucugauaaguc

SEQ ID NO: 14398 - RNA, 60 nt, Human
uacuguuagguugucuuuuuaacgugcuaucaucgauacaacaaauuuuuuuaaagaaca

SEQ ID NO: 14399 - RNA, 62 nt, Human
auuucaccuggugaaucaguguuuuaaauaagaaagguaauaguugguaaggccaauguuau

SEQ ID NO: 14400 - RNA, 58 nt, Human
aagccacccccaccccucgccagcuagcuccauagggaagccugugucuccugccccc

SEQ ID NO: 14401 - RNA, 62 nt, Human; identical to SEQ ID NO: 10716

SEQ ID NO: 14402 - RNA, 62 nt, Human; identical to SEQ ID NO: 12951

SEQ ID NO: 14403 - RNA, 62 nt, Human
caugaaauuuuuugcaggaaaagaaaccagaaauacagaauaauucauagaaaucaugguuc

SEQ ID NO: 14404 - RNA, 62 nt, Human
uuuggucuaucuuuuaaagccugaucuggugugaauaaucaacuaggaaaucuaaacuugga

SEQ ID NO: 14405 - RNA, 62 nt, Human; identical to SEQ ID NO: 13772

SEQ ID NO: 14406 - RNA, 60 nt, Human
agagggacagaccgucagaaacuggagaguuucuauuaaaggucauuuaaaccacugaag

SEQ ID NO: 14407 - RNA, 62 nt, Human; identical to SEQ ID NO: 11495

SEQ ID NO: 14408 - RNA, 62 nt, Human
ucugccagccgauguguccucaucucaggcccgugccugggaccccgugucugcccaggugg

SEQ ID NO: 14409 - RNA, 62 nt, Human
aauugauaaugguaccaccuucuauaauaauaauauaaaauaaaaacaucugaugucugggu

SEQ ID NO: 14410 - RNA, 60 nt, Human
ugcucaugugcgugagagugggaaccaucuccuugcggcaguggcuuccgcgugccccgu

SEQ ID NO: 14411 - RNA, 62 nt, Human
cccugcccccuggcccccacucccccggcuccguguaaaauaaauguuccagcccaaccugu

SEQ ID NO: 14412 - RNA, 61 nt, Human
aauugagccauuuuuuuaaaguaauagauacuaauagauuaucuuuucugaugcacuggac

SEQ ID NO: 14413 - RNA, 62 nt, Human
agcccagcucucgauacguuuggucuuucaugcugaaaaauaaauaauaaagccugucccgu

SEQ ID NO: 14414 - RNA, 55 nt, Human
cagagcucgccccugcacugcagccuugugggggagggcaaggcucuccucccag

SEQ ID NO: 14415 - RNA, 62 nt, Human
gacaguucuuugcacacaaguuuuacaccucucuggauucgaaguuuguauuguauucauag

SEQ ID NO: 14416 - RNA, 60 nt, Human
ccauuauggggacuuugguuugacccaggggucagccuuaggaaggccuucaggaggagg

SEQ ID NO: 14417 - RNA, 62 nt, Human
gcaggagaaucauuugaacccgggaggcagagguugcggugagcugagaucgcgccacugca

SEQ ID NO: 14418 - RNA, 62 nt, Human; identical to SEQ ID NO: 11994

SEQ ID NO: 14419 - RNA, 62 nt, Human; identical to SEQ ID NO: 10710

SEQ ID NO: 14420 - RNA, 62 nt, Human; identical to SEQ ID NO: 10919

SEQ ID NO: 14421 - RNA, 62 nt, Human
auuagcggggagagagauggagcaucgagugacacugggccauccaggcggcucugcuccca

SEQ ID NO: 14422 - RNA, 56 nt, Human
cucuggcuugaaccauggcugagcagugccggcauacgcuuugcuggcaugcuugg

SEQ ID NO: 14423 - RNA, 62 nt, Human
guugucucaagucaaauggauucaucaccugucaugcauugacaccugauacccagacuuaa

SEQ ID NO: 14424 - RNA, 60 nt, Human
guggcuuccccggcagcagccccaugauggcugaauccgaaauccucgauggguccagcu

SEQ ID NO: 14425 - RNA, 62 nt, Human
aauccugcugcucugguccuugugauaagccucucuucggcaucugaggagcagcugcagca

SEQ ID NO: 14426 - RNA, 60 nt, Human
ugcaugguggcagucugcuuggcagggaguucuccgcggacgcuaccaguuucauuugua

SEQ ID NO: 14427 - RNA, 62 nt, Human
cugagcauucagacccccaggccccagcacuuggcguuuucaggaggcccuguucuuagagc

SEQ ID NO: 14428 - RNA, 56 nt, Human
gccaagauucccaaagucaaggcccaaagauuuccaagguucccaaagucaaggcc

SEQ ID NO: 14429 - RNA, 62 nt, Human
ccugagggccccugugucccgaacccggagcggaggcgcccaacccggcagacgggugcagg

SEQ ID NO: 14430 - RNA, 62 nt, Human; identical to SEQ ID NO: 11399

SEQ ID NO: 14431 - RNA, 62 nt, Human
aguguccaucuuuccacccucccugaucuccagaaccuucgacugacccccuugucuuuaug

SEQ ID NO: 14432 - RNA, 62 nt, Human
ccuaaaugaaauaacuuucuucucuuccccuuccccacccgaauucuuuucugaaguugcug

SEQ ID NO: 14433 - RNA, 62 nt, Human
ccaccgugccuggucuguuuuuuuuuuuuuuuuggcaauagagucuugcucgcccagggugg

SEQ ID NO: 14434 - RNA, 61 nt, Human
cccuuuugguaaccguauugacugcagagucuauuuaagcaugugguuuuaaaaauagaca

SEQ ID NO: 14435 - RNA, 62 nt, Human
ggacucuuaacacgguauccucgcuaguugguuuuaagggaaacacucugcuccugggugug

SEQ ID NO: 14436 - RNA, 60 nt, Human; identical to SEQ ID NO: 11878

SEQ ID NO: 14437 - RNA, 62 nt, Human
gaaaaguccaaaccuggagaugucccugugccuccgccccuacccaccccuuuuccuucagc

SEQ ID NO: 14438 - RNA, 60 nt, Human
uggcuucuuuggggaacccacaaggccugcgugcuugcuacgccaggcccucuuugcccu

SEQ ID NO: 14439 - RNA, 62 nt, Human
accagauccuuaugacgcagcugaugccugccuugguuccuaccacucugguguagacagag

SEQ ID NO: 14440 - RNA, 60 nt, Human
aggcccggacucucccuagcuaagggccaugugcgguggaguguccuaauuuugcagggu

SEQ ID NO: 14441 - RNA, 62 nt, Human
gugcauagucuccagagcuucaaaggcaacacaagcucgcaacucuaagauuuuuuuaaacc

SEQ ID NO: 14442 - RNA, 60 nt, Human
ucggaugggcuuuaaauuauucccauaggggccaauuucaaauaauaauuuuuuucccug

SEQ ID NO: 14443 - RNA, 62 nt, Human; identical to SEQ ID NO: 10534

SEQ ID NO: 14444 - RNA, 60 nt, Human; identical to SEQ ID NO: 12022

SEQ ID NO: 14445 - RNA, 62 nt, Human
aaacggagcugccaaggugggaggaggcccacaguucccuaaaacacccuuccggcgggagc

SEQ ID NO: 14446 - RNA, 61 nt, Human
ggaggcucaggcagacaaaucgcucuagcucagaaguugcagagcagccugggcaacaugg

SEQ ID NO: 14447 - RNA, 62 nt, Human
cugaggacuuguacaugaaaauagacagcauucaggcggacaucuuggcggccaacacaguc

SEQ ID NO: 14448 - RNA, 59 nt, Human
cugagaccauggaauugcacugcagcaugggcaacaagagucaaacucccucuaaaaaa

SEQ ID NO: 14449 - RNA, 62 nt, Human
cauuuguuuacaacuguguuccaagcagguuucauaaagaaauucuuaaccuuagaaccucg

SEQ ID NO: 14450 - RNA, 61 nt, Human
ggaaacaauggaaacuuacagaugccugccugggaugaugaggcacauucagaacaaaugc

SEQ ID NO: 14451 - RNA, 62 nt, Human
cuaugaccaaagcuucuauuuugccaaaaaguuaaauaccgauaaaauggccuuaaguguau

SEQ ID NO: 14452 - RNA, 61 nt, Human
auuacagagggcucauuuucuacgucauguauuuuaugauacuugaauuuuuugaaauggg

SEQ ID NO: 14453 - RNA, 62 nt, Human
acaugggugcaagucagcauuguaaguuuucucagguuauuauuauuagagagguuggaaac

SEQ ID NO: 14454 - RNA, 52 nt, Human
gagcaaucccagcggaucgcuccgggccaccaagccgcaccugugccugaga

SEQ ID NO: 14455 - RNA, 62 nt, Human
guucuauuuauuucuuguauuguuuggaagaaaaaaugaugauagagucccaaaaagaagag

SEQ ID NO: 14456 - RNA, 60 nt, Human
aaaagaugcaaaaguguucagccaagugacguuuacuaaauagccaauaaagggcuggug

SEQ ID NO: 14457 - RNA, 62 nt, Human; identical to SEQ ID NO: 11159

SEQ ID NO: 14458 - RNA, 61 nt, Human
gggaaguuaugggguagcuaauuucccauuuacaacacagaaaugauauagagcuaguucg

SEQ ID NO: 14459 - RNA, 62 nt, Human; identical to SEQ ID NO: 13965

SEQ ID NO: 14460 - RNA, 61 nt, Human
agggucucacucugucgcucaggcuggagugcagugaugcaaucuuggcucacugcaaccu

SEQ ID NO: 14461 - RNA, 62 nt, Human
uagagagggcgccugcagccuuaaccuccacggccuucgauacuuaugcaagccugguguug

SEQ ID NO: 14462 - RNA, 60 nt, Human
uuguuauuugauguguuaauaaagaagcacauauauagcaagucaggaaacuuaaaacau

SEQ ID NO: 14463 - RNA, 62 nt, Human; identical to SEQ ID NO: 11715

SEQ ID NO: 14464 - RNA, 56 nt, Human
gucucuguucgcucgcuuaagcuguuuugaagccaagugaagagugugguuugcau

SEQ ID NO: 14465 - RNA, 62 nt, Human
ggagccguagauuccgugccugccgccgcagcgccgccgacaacgcgggugcaggggggcgc

SEQ ID NO: 14466 - RNA, 57 nt, Human
uccgaucguucucccgcugagcuguuuucaagggcaagugcuuguugaagucuugcc

SEQ ID NO: 14467 - RNA, 62 nt, Human
cagcugaugccugccuugguuccuaccacucugguguagacagaggacuuuguccaagucuc

SEQ ID NO: 14468 - RNA, 61 nt, Human
gggucccuuugacauggacagcugcuuaucaagacacuccaucaaccccuacaguaacagg

SEQ ID NO: 14469 - RNA, 62 nt, Human; identical to SEQ ID NO: 10158

SEQ ID NO: 14470 - RNA, 59 nt, Human
agcauuuuccccauguggcucucucacugugcguugcuaccuugcuucugugagaauuc

SEQ ID NO: 14471 - RNA, 62 nt, Human
ucauuugaaaaugaggguccgugguagcugugcguuuugcuaucauugcuaagagauucccg

SEQ ID NO: 14472 - RNA, 61 nt, Human
cguguugccaggaguggugacaagaaaugcagcuuacaucaaacgaacauguagugcaugc

SEQ ID NO: 14473 - RNA, 62 nt, Human; identical to SEQ ID NO: 13030

SEQ ID NO: 14474 - RNA, 52 nt, Human
gagcccucaggaggcggccgcgggccgcgcaagacagggcggccagcccggc

SEQ ID NO: 14475 - RNA, 62 nt, Human
gcgcugagccgggccccggggccgcgggcggggcgcccacgagaugcugaugacgagcaggc

SEQ ID NO: 14476 - RNA, 62 nt, Human
auaauccagucuucacuggguucccauucugaggguccacuacucaaaaauuugcuucacuc

SEQ ID NO: 14477 - RNA, 62 nt, Human; identical to SEQ ID NO: 14475

SEQ ID NO: 14478 - RNA, 57 nt, Human
ugguggcuuucaaacuucagaccaugaucugcagcaagaaacgugccuuccaucaua

SEQ ID NO: 14479 - RNA, 62 nt, Human; identical to SEQ ID NO: 14432

SEQ ID NO: 14480 - RNA, 61 nt, Human
gcaggcugcagguuuccugcccucauggacgcucgcgaggaucuaccagcccugcaaguuu

SEQ ID NO: 14481 - RNA, 62 nt, Human
cauccccgcccagagccgggcgucguguggguccgugggugauaauugagagcgucagaccc

SEQ ID NO: 14482 - RNA, 60 nt, Human
ccacugcuaccuguuuacccacccuggucccucccagacaagcaaggccucugauuucuu

SEQ ID NO: 14483 - RNA, 62 nt, Human
gaucugcguguguccagaaguggcccuuggccgagcgccgaacucgcucgcccucuagaugu

SEQ ID NO: 14484 - RNA, 62 nt, Human
caaaagguuucuccuguaauauuuuaucccuggacuugucaagugaauucuuugcauguuca

SEQ ID NO: 14485 - RNA, 62 nt, Human
ccgaucuggguguccugacccucagcuggcccugcccagccacccuggacgugaccguaucc

SEQ ID NO: 14486 - RNA, 57 nt, Human
gaagaaauacaacgcacaguacuuuugaagcuucguauuuuucuugguuucacacuc

SEQ ID NO: 14487 - RNA, 62 nt, Human; identical to SEQ ID NO: 12424

SEQ ID NO: 14488 - RNA, 62 nt, Human
gccucucagaagagccucuacugaaaaauauggaucaucacagauccaaacagaaaaauggg

SEQ ID NO: 14489 - RNA, 62 nt, Human
ccuuauuccucccucauaccuagccauuucuccaaggcgcaaauggcccuggcuucauuuau

SEQ ID NO: 14490 - RNA, 62 nt, Human
ccugugucccgaacccggagcggaggcgcccaacccggcagacgggugcaggcccggccuuu

SEQ ID NO: 14491 - RNA, 62 nt, Human
cguugauaggaagcggaaggggaaucgcgggaagcuggcccaggucagguccgcaaaggcuu

SEQ ID NO: 14492 - RNA, 52 nt, Human
ggcuugugcaguggaucugauggccgcggugagguggguucucaggaccacc

SEQ ID NO: 14493 - RNA, 62 nt, Human
auugcacuccagccuggaugauagagugagacuguaccucuaaauaaccaaaaccuugauua

SEQ ID NO: 14494 - RNA, 59 nt, Human
guggacuccagcauguuucugauaauuaugcaagcaacaauucuguagccucaaguaag

SEQ ID NO: 14495 - RNA, 62 nt, Human; identical to SEQ ID NO: 11139

SEQ ID NO: 14496 - RNA, 54 nt, Human
agcuugcccagcuaggagcagcagcaacacgagacccuccagcuuugggagcca

SEQ ID NO: 14497 - RNA, 62 nt, Human
ccucgggcugccuuccccucugcguguuucgaagugggaugacagucggccacggaaaacaa

SEQ ID NO: 14498 - RNA, 60 nt, Human
ugugugucgugugggaguggggcgauuuuuuaugugccaaauacccccgucccccccaug

SEQ ID NO: 14499 - RNA, 62 nt, Human
aguuccacacaguaaucugagcagugacucauggaaggaugaggaacguuugcuccagcuuc

SEQ ID NO: 14500 - RNA, 61 nt, Human
ggaaugaaaaacaccaccaguuugaaucgccuagaugaaaaucuuuuccucuggguguuau

SEQ ID NO: 14501 - RNA, 62 nt, Human; identical to SEQ ID NO: 13634

SEQ ID NO: 14502 - RNA, 58 nt, Human
cuuccuguacauauauuuaagugacaaacacggucaaaagcuuaagggacagguuuua

SEQ ID NO: 14503 - RNA, 62 nt, Human
ccuuuaagacuucaucuccaugugaagggcucacuguuucuaccaaggcugugccuguauua

SEQ ID NO: 14504 - RNA, 61 nt, Human
aggaugugcagggcugccucagaagcuggcuggggacucuagccucuguguucauaaagac

SEQ ID NO: 14505 - RNA, 62 nt, Human
ugcuuuauuaagcaugagaaagaaucuuaagaauugucaauaaaauuaacccaaaacuuuaa

SEQ ID NO: 14506 - RNA, 62 nt, Human
gucuuugucucuuccuuucaccucauucugguagcagcauaaagguuaggcaaucacuggga

SEQ ID NO: 14507 - RNA, 62 nt, Human
gcaagggaugccaguaagucugcaggugcggggugccaccuacaggcccaggccuguguccc

SEQ ID NO: 14508 - RNA, 62 nt, Human
gggacccugccgagggggcugucaugcgguuuccaaggugcacauuuuccacggaaacagaa

SEQ ID NO: 14509 - RNA, 62 nt, Human; identical to SEQ ID NO: 9490

SEQ ID NO: 14510 - RNA, 60 nt, Human; identical to SEQ ID NO: 12002

SEQ ID NO: 14511 - RNA, 62 nt, Human
cucucuugggacgcaacuucuuccccacucggaugggcuuuaaauuauucccauaggggcca

SEQ ID NO: 14512 - RNA, 60 nt, Human
uacgaaggugaggucugggaugcugcgugcggcgcgacgacaggagguaugaccugggug

SEQ ID NO: 14513 - RNA, 62 nt, Human
acuaaaaagccuccacggacaucgauaaucaagagauuauuaagaucuuugcuagaagaguu

SEQ ID NO: 14514 - RNA, 61 nt, Human
aacaagacuccaccacugaguggcaccugcccuauugcaaaggaauccaguuccuccggaa

SEQ ID NO: 14515 - RNA, 62 nt, Human
uguaaggucuuuagagauuuuuuuuuuaagguucaggccguagguuccucaaggaaucucuu

SEQ ID NO: 14516 - RNA, 59 nt, Human
aggugguuaaagucgucaaaguuguaagugacuaaccaagauuauuucauuuuaaaacc

SEQ ID NO: 14517 - RNA, 62 nt, Human
gccuuccagaaaaaaacacuacugccuaacacaaaucugugauaacaacaggcugugccuua

SEQ ID NO: 14518 - RNA, 57 nt, Human
uuacuugcacaguggauuggagagaaaggauucuccagugugcacacucaucgguac

SEQ ID NO: 14519 - RNA, 62 nt, Human
augcagugguucccaugcuuaacaaaucauuaaaacacccuagaacacuccuaggauagauu

SEQ ID NO: 14520 - RNA, 62 nt, Human
ggucggaggacagagaaaggucagcagggucagaguaugugaggucagagggcaugaggguc

SEQ ID NO: 14521 - RNA, 62 nt, Human; identical to SEQ ID NO: 10131

SEQ ID NO: 14522 - RNA, 62 nt, Human; identical to SEQ ID NO: 9599

SEQ ID NO: 14523 - RNA, 62 nt, Human
cucuggggcuacagcuucugccuccucaccuggccgucgguacucggcaagcaggccuggcc

SEQ ID NO: 14524 - RNA, 62 nt, Human
cuugcacccaaggggcuuuucacgaugcucccacgcguccaagggugcggagucucccuccg

SEQ ID NO: 14525 - RNA, 62 nt, Human
cccuacuuaacauacuugaauucucaaauuuccuuugggguaaaaaaaaaaaaaggauuuga

SEQ ID NO: 14526 - RNA, 53 nt, Human
cauagaauuaagaggguucucauggaggggauaggaaguagguuuaaagccua

SEQ ID NO: 14527 - RNA, 62 nt, Human
uggacgcagcggcaccccucgguuauuaaggagggaggaguaggggauagaaguauuucaaa

SEQ ID NO: 14528 - RNA, 61 nt, Human
ccagagcccuuucugcacagcuggugucggcaucauacuaaaagcaauguuuaaaucaaac

SEQ ID NO: 14529 - RNA, 62 nt, Human
cuguaggaacgucaaggucgugggaaauaaaaggcaguucuacacagacugcagcaacgguu

SEQ ID NO: 14530 - RNA, 62 nt, Human
cgcaccugugccugagacuccggauggacgacacagucgucacgucgcucuuccugcggguu

SEQ ID NO: 14531 - RNA, 62 nt, Human; identical to SEQ ID NO: 10962

SEQ ID NO: 14532 - RNA, 60 nt, Human
ucugcuuuacucuggaccauaggaaacaagaccguuuggagguuucaucaggauuuuggg

SEQ ID NO: 14533 - RNA, 62 nt, Human
guuucugugaaacuguauauuuuguaaauaaauauauugcuacuuugagguucaugauucaa

SEQ ID NO: 14534 - RNA, 49 nt, Human; identical to SEQ ID NO: 9924

SEQ ID NO: 14535 - RNA, 62 nt, Human; identical to SEQ ID NO: 13685

SEQ ID NO: 14536 - RNA, 60 nt, Human
ucagaauuaaaaucauuaccuugugugugaaccuucuacaucuucauaggccuuucuucc

SEQ ID NO: 14537 - RNA, 62 nt, Human
ucaugcugccccuggcgccuagaacccuugccccuccucauagaccaagucccgggggucuc

SEQ ID NO: 14538 - RNA, 60 nt, Human
ggcuguaaaaggcacaggggacucuggccugcggaggccagaaaauguaucgggaauccc

SEQ ID NO: 14539 - RNA, 62 nt, Human
agcccccuccuuuuuuuuuuuuuuuuucuuuuuuuaggcauauguaguaauauuagaaacau

SEQ ID NO: 14540 - RNA, 62 nt, Human
cuagggguucagagccuggcagaauugucagcuuuagucugacauaaucuaaggguaugggg

SEQ ID NO: 14541 - RNA, 62 nt, Human
uuugaaaaguguuuguuauuuaaauuccaauaaugcccaauacugacgugucuugaguaauu

SEQ ID NO: 14542 - RNA, 62 nt, Human
aaagauauuuauuggccaggaaguuggugcugcuaagaccgagaaauuuaaagaaucggaca

SEQ ID NO: 14543 - RNA, 62 nt, Human
gauuuuccucccuccuguuucaggugggucacauucugaugaauguuucccuuguacagauc

SEQ ID NO: 14544 - RNA, 61 nt, Human
ggccuuccaccucccucagcuuccugcauggacccaccuuacuggccagucugcauccuug

SEQ ID NO: 14545 - RNA, 62 nt, Human
uaggcaguuuguaagauuccuccuaacuuucacagucgaugacaagauugucuuuuuaucug

SEQ ID NO: 14546 - RNA, 60 nt, Human
agagacugcccagcuggagaggccuuccuuuacaaggccacgcgugcagcugucccaucc

SEQ ID NO: 14547 - RNA, 62 nt, Human
ugggcgccccaucccccaacagaacucccgggccccaauccaguauacccuaacccuugaug

SEQ ID NO: 14548 - RNA, 62 nt, Human
gccauguggcuuauuaacagcuuccaguggaagucgcaauaaacaguuuuugguaaaucuca

SEQ ID NO: 14549 - RNA, 62 nt, Human
cuuuuuuuguuuuugguuuuuuaugguuuuuuaaggaaaauacuuuucuccuuugaaguuuu

SEQ ID NO: 14550 - RNA, 60 nt, Human
caaccuccgccucccagguucaagcgauucuccuaccucagcccccagaguagcugggau

SEQ ID NO: 14551 - RNA, 62 nt, Human
ggucgcggaagggaauggauagacuggugugcucaaaagagagagaucacucaaaugauuuu

SEQ ID NO: 14552 - RNA, 60 nt, Human
gagacuggagucuugcuuuguggauccuuuuggucuccgaguccugcagucugcaggugc

SEQ ID NO: 14553 - RNA, 62 nt, Human
cccagcucguuguuaaacgugcugacggcaaggggcaauggagugaguuucccaacuaagaa

SEQ ID NO: 14554 - RNA, 60 nt, Human
ccaguggccucaccucucugugccucgaugucuucaucuacgauacuucugguucccucc

SEQ ID NO: 14555 - RNA, 62 nt, Human
cuggccguccacagggucggcccucagcucagcccgccaggagucagggaggagacucgcug

SEQ ID NO: 14556 - RNA, 62 nt, Human
ucucuucaugaagaaccagcggaacucaaaacugcuguucaagaaaccucuucaagacuuuu

SEQ ID NO: 14557 - RNA, 62 nt, Human
uggccauggcgcucugugccugcggccgaugcguugcugcgaacagcauaggugagacucug

SEQ ID NO: 14558 - RNA, 60 nt, Human; identical to SEQ ID NO: 11724

SEQ ID NO: 14559 - RNA, 62 nt, Human; identical to SEQ ID NO: 10254

SEQ ID NO: 14560 - RNA, 61 nt, Human
gcccacucccgccagccccugccucgaggacugauacugcagugacugccgucagcuccga

SEQ ID NO: 14561 - RNA, 62 nt, Human; identical to SEQ ID NO: 13739

SEQ ID NO: 14562 - RNA, 60 nt, Human
gccuagccaccucagcugcagggaggcagaaggcaaggcaggccccacggacacacuugg

SEQ ID NO: 14563 - RNA, 62 nt, Human
aguuuguuggccacagguugaaaaggaaaggaauaaacgggaguucugcaugugaguucuca

SEQ ID NO: 14564 - RNA, 59 nt, Human
cccugugaacagguauuuucaggacucaaacuaccacaaugaacagaguauagauuuua

SEQ ID NO: 14565 - RNA, 62 nt, Human; identical to SEQ ID NO: 10254

SEQ ID NO: 14566 - RNA, 62 nt, Human
cuagccaaaaggcaguuuuggaaacuacauugggggacguuauuuuuauuuauauauggggc

SEQ ID NO: 14567 - RNA, 62 nt, Human; identical to SEQ ID NO: 10254

SEQ ID NO: 14568 - RNA, 62 nt, Human; identical to SEQ ID NO: 14566

SEQ ID NO: 14569 - RNA, 62 nt, Human
uggggccuccuguggauaccggucaccaguucugccgugcgauggcagcagcuuuugugucc

SEQ ID NO: 14570 - RNA, 62 nt, Human
aaugagacaauuuuccuaccaaaggaagaacaaaaggauaaauauaauacaaaauauaugua

SEQ ID NO: 14571 - RNA, 62 nt, Human
gcggugcugggccccccgaggcugcaccuggcucucggcugaggauugucaccccaagucuu

SEQ ID NO: 14572 - RNA, 62 nt, Human
ugcucucuguuggcucugcaugcauguauccucuggcgcgaauaucauuggagcugccuguc

SEQ ID NO: 14573 - RNA, 62 nt, Human
uggacagcagcuggacugggugggccccacaguggucagcgauuccugccaaguaggguuua

SEQ ID NO: 14574 - RNA, 61 nt, Human
aacaccugaaaaaacucaagcugacuuccacugcgaagggaaauuauugguuuguguaacu

SEQ ID NO: 14575 - RNA, 62 nt, Human
ccaggcaugguggcgcaugccuguaaucccagcuacucgagaggcugaggcaggagaaucgc

SEQ ID NO: 14576 - RNA, 61 nt, Human
ucacacuucuguccaccuggccuccucucgccuggccgccagccccagccccagccccagc

SEQ ID NO: 14577 - RNA, 62 nt, Human; identical to SEQ ID NO: 9891

SEQ ID NO: 14578 - RNA, 62 nt, Human
ggaguggggguggcggccgccccacccuccccacccggggaagccaucacagcucaucugcc

SEQ ID NO: 14579 - RNA, 62 nt, Human
cagacagaccuuuuuaaguccuggacuuuuaaaugaccaugaaguuaucauugaauguuaag

SEQ ID NO: 14580 - RNA, 62 nt, Human
caguuuugcucugcccagcaguguuggugcccagagaugacaagggccagggagccuggccc

SEQ ID NO: 14581 - RNA, 62 nt, Human; identical to SEQ ID NO: 9711

SEQ ID NO: 14582 - RNA, 56 nt, Human
gcagaugcugccuuauuuggccacugaaacaaucaaagcuaauaaaugcuuaaaga

SEQ ID NO: 14583 - RNA, 62 nt, Human
uguauauuuauccagcuauacuuacuugcacaguggauuggagagaaaggauucuccagugu

SEQ ID NO: 14584 - RNA, 60 nt, Human
uugacuggaugaguccuggcagucuuucuaggcgaaccaagaauguuugugugagggaag

SEQ ID NO: 14585 - RNA, 62 nt, Human
ucaaguaggcauuaucaccaugcgacagguugaggaccgugaggcacgcuggaguuauuuga

SEQ ID NO: 14586 - RNA, 60 nt, Human
agccaggugcaguccccgccccgccuaguccucggcgucacgcaaugcucaccucgccuc

SEQ ID NO: 14587 - RNA, 62 nt, Human
uaauuggauauuggacucugcucauauaagcuacagacaaaagccaaaagacucucgcuguc

SEQ ID NO: 14588 - RNA, 62 nt, Human; identical to SEQ ID NO: 9404

SEQ ID NO: 14589 - RNA, 62 nt, Human
guuuacccacccuggucccucccagacaagcaaggccucugauuucuuugaagcauuuacuu

SEQ ID NO: 14590 - RNA, 57 nt, Human
uaccagugacguucgccaucauaccgccagcgcgacagccaccuggugccaacucac

SEQ ID NO: 14591 - RNA, 62 nt, Human
uccuaaacaaaguuuuuacacugagcagaugcucugucaugauggcgguugugcaauucugg

SEQ ID NO: 14592 - RNA, 60 nt, Human
uuguuucacugugcagagauuucucuguaagggcaacgaacgugcuggcaucaaagaaua

SEQ ID NO: 14593 - RNA, 62 nt, Human
gcacgggcuccccugaaggauugucgaggccaggguucgggaaguacacugccaucggucag

SEQ ID NO: 14594 - RNA, 58 nt, Human
gaaggagagcaauuucuaaguuucaauccugcgcuguacaguugaagaagagugugga

SEQ ID NO: 14595 - RNA, 62 nt, Human
uuaaaagcgagaaaaaagaauauacacauaauuucugacggaaaaccuguacccugaugcug

SEQ ID NO: 14596 - RNA, 60 nt, Human
uugaacuuagggcaaaucagagucuacacagacgccuacagaaaguuucaggaagaggca

SEQ ID NO: 14597 - RNA, 62 nt, Human; identical to SEQ ID NO: 12235

SEQ ID NO: 14598 - RNA, 57 nt, Human
guuacucuuugccaacagcuuuacggacauuggaugaagccgaagcauuuagaaugg

SEQ ID NO: 14599 - RNA, 62 nt, Human
ccagaggcagagagacgaggauacccagcgaaagggacgggaggaagcauccgaaaccuagg

SEQ ID NO: 14600 - RNA, 60 nt, Human
cccuugaacagggcaguguuguggggacugcaaaagagaaaacguccaggcgagcccagu

SEQ ID NO: 14601 - RNA, 62 nt, Human; identical to SEQ ID NO: 10019

SEQ ID NO: 14602 - RNA, 59 nt, Human
uguauugcauuccagcagaccacugaaccagacagcgaagccaagaucauuguucuacu

SEQ ID NO: 14603 - RNA, 62 nt, Human
ccacugaggugacagcucauuagcggggagagagauggagcaucgagugacacugggccauc

SEQ ID NO: 14604 - RNA, 62 nt, Human
guuuguuuguuuguuuuaaucucuacagcacauuuaaugcaacuuuugaaaucugcagguuu

SEQ ID NO: 14605 - RNA, 62 nt, Human
uggcgggcggagcuaagggccuccaccagcauccgagcaggaucaagggccggaaauaaagg

SEQ ID NO: 14606 - RNA, 61 nt, Human
cuccugaaugcauccaugaauuuguuuacuuuugcgucaaacauaugagccauugucaugc

SEQ ID NO: 14607 - RNA, 62 nt, Human; identical to SEQ ID NO: 11977

SEQ ID NO: 14608 - RNA, 55 nt, Human
cuagccuggaaaacagagugagacccuaucucaaaaaaaaaaaaaaaaaaaaagg

SEQ ID NO: 14609 - RNA, 62 nt, Human; identical to SEQ ID NO: 12924

SEQ ID NO: 14610 - RNA, 54 nt, Human
cucuugcaguauuuggauuugcuugaaaccgggaaaacuguucccauuaggcuu

SEQ ID NO: 14611 - RNA, 62 nt, Human; identical to SEQ ID NO: 12478

SEQ ID NO: 14612 - RNA, 62 nt, Human
gggcaggugcagagguggcagggauggcuccgaagccagaaaugccuuaaacugcaacgucc

SEQ ID NO: 14613 - RNA, 62 nt, Human
uuucagacgcauuuccaagaguccagcaagccagggggaagaugaucccuuugccgaagugu

SEQ ID NO: 14614 - RNA, 60 nt, Human
gggagggugaggcuuuguaccccagccccugcccaggccacugugagggugggugcuggc

SEQ ID NO: 14615 - RNA, 62 nt, Human
guccacagaguugcccagaacccuaaauuuauucauaagagaaaauauugauuaauuauugg

SEQ ID NO: 14616 - RNA, 60 nt, Human
gagaagguauagccccaucuugauagaagaguuacuccgagcuuuaucauggaccagagg

SEQ ID NO: 14617 - RNA, 62 nt, Human; identical to SEQ ID NO: 10819

SEQ ID NO: 14618 - RNA, 60 nt, Human
acucccuuaagcccagacaucuguugagaccugaccccuagucauugguuaccagugugu

SEQ ID NO: 14619 - RNA, 62 nt, Human
uucccugugccucagcacuccuuuccugguugcagauaacgaacuaagguugccuaaagggc

SEQ ID NO: 14620 - RNA, 61 nt, Human
acaccaucugcaaugaucucuacaucuaugauacucgcacaucuccuccuuugugguucca

SEQ ID NO: 14621 - RNA, 62 nt, Human; identical to SEQ ID NO: 11959

SEQ ID NO: 14622 - RNA, 61 nt, Human
cuggcuggggacucuagccucuguguucauaaagacauuaagaaguggauggauguuguuc

SEQ ID NO: 14623 - RNA, 62 nt, Human
ugcaucagccugcggguggccucuggauccuccguggaccgaaccguccccccaggaacaca

SEQ ID NO: 14624 - RNA, 61 nt, Human
auuccuugauuuaggacugggaauaauucugacaccauauauaaaagaaguuugaagcaau

SEQ ID NO: 14625 - RNA, 62 nt, Human
ccccgcccuugggacagccuccuccguagccccugcacggcaccaguuccccgagggacgca

SEQ ID NO: 14626 - RNA, 61 nt, Human; identical to SEQ ID NO: 9252

SEQ ID NO: 14627 - RNA, 62 nt, Human
agagcgucagacccaggacuguucagggaggagccccggucagacucccacgugugaagacc

SEQ ID NO: 14628 - RNA, 61 nt, Human
ccagggggccacguagcagcggcucaguggguggccaucgaucuggaccguccccugccca

SEQ ID NO: 14629 - RNA, 62 nt, Human
ggcacuggcuagggaggggcaggccuccuuccugccccucgagacacucuugggagaugcau

SEQ ID NO: 14630 - RNA, 62 nt, Human; identical to SEQ ID NO: 10017

SEQ ID NO: 14631 - RNA, 62 nt, Human; identical to SEQ ID NO: 14629

SEQ ID NO: 14632 - RNA, 62 nt, Human; identical to SEQ ID NO: 10017

SEQ ID NO: 14633 - RNA, 62 nt, Human
gcauagcuaacccccuucccacuccugagucacugaauucgaggaggguggggcagggaaag

SEQ ID NO: 14634 - RNA, 62 nt, Human; identical to SEQ ID NO: 10444

SEQ ID NO: 14635 - RNA, 62 nt, Human; identical to SEQ ID NO: 10662

SEQ ID NO: 14636 - RNA, 60 nt, Human
gguaccaggaagugcagagccgcacaggagcugccccggagcugaggggacggucuucgg

SEQ ID NO: 14637 - RNA, 62 nt, Human
ugauuuugcuuuugcuuuucuagcugagauuucccaagugcauccucagaagcucugggugu

SEQ ID NO: 14638 - RNA, 60 nt, Human; identical to SEQ ID NO: 11590

SEQ ID NO: 14639 - RNA, 62 nt, Human
gucugagcccaagaguucaagaucagccugggcaguauagcaagaccccaucuccauuuuuu

SEQ ID NO: 14640 - RNA, 60 nt, Human
gagcggugaucaaagccgagaaacagcuaccagcgguacaccccuguaguuuaggacaca

SEQ ID NO: 14641 - RNA, 62 nt, Human; identical to SEQ ID NO: 10623

SEQ ID NO: 14642 - RNA, 62 nt, Human; identical to SEQ ID NO: 13044

SEQ ID NO: 14643 - RNA, 62 nt, Human
cagcugcccgugcaggcccggacucucccuagcuaagggccaugugcgguggaguguccuaa

SEQ ID NO: 14644 - RNA, 58 nt, Human
gccagccccuccccaggagcccggggccaccgaccgcaggugugagccuggccguccu

SEQ ID NO: 14645 - RNA, 62 nt, Human; identical to SEQ ID NO: 14425

SEQ ID NO: 14646 - RNA, 61 nt, Human
ucuacuaaaaauacaaaaaauuagccaggcauggugccgcauaacuauaaucccagcuacu

SEQ ID NO: 14647 - RNA, 62 nt, Human
ugauggccgcggugagguggguucucaggaccacccucgccaagcuccaggguaccugcccc

SEQ ID NO: 14648 - RNA, 62 nt, Human; identical to SEQ ID NO: 9245

SEQ ID NO: 14649 - RNA, 62 nt, Human
ccagcccagcccaaggcccccaggagcugggacucugcuacacccagugaaaugcugugucc

SEQ ID NO: 14650 - RNA, 60 nt, Human
aaguucuuccagccucaccagcaccuggcagcgagucagagccugugagggcauccgaag

SEQ ID NO: 14651 - RNA, 62 nt, Human; identical to SEQ ID NO: 13692

SEQ ID NO: 14652 - RNA, 62 nt, Human; identical to SEQ ID NO: 13919

SEQ ID NO: 14653 - RNA, 62 nt, Human
acaauuggucaaaaugaacuccauugcuuaagaaacacauaaacaccauuuagucacugaac

SEQ ID NO: 14654 - RNA, 62 nt, Human; identical to SEQ ID NO: 13116

SEQ ID NO: 14655 - RNA, 62 nt, Human; identical to SEQ ID NO: 12015

SEQ ID NO: 14656 - RNA, 58 nt, Human
ugccuucucccagaguuuucuuuggagaacagaaagaagaaaggaaagaaaggaacca

SEQ ID NO: 14657 - RNA, 62 nt, Human; identical to SEQ ID NO: 12015

SEQ ID NO: 14658 - RNA, 58 nt, Human; identical to SEQ ID NO: 14656

SEQ ID NO: 14659 - RNA, 62 nt, Human; identical to SEQ ID NO: 12015

SEQ ID NO: 14660 - RNA, 58 nt, Human; identical to SEQ ID NO: 14656

SEQ ID NO: 14661 - RNA, 62 nt, Human; identical to SEQ ID NO: 12015

SEQ ID NO: 14662 - RNA, 58 nt, Human; identical to SEQ ID NO: 14656

SEQ ID NO: 14663 - RNA, 62 nt, Human; identical to SEQ ID NO: 12015

SEQ ID NO: 14664 - RNA, 58 nt, Human; identical to SEQ ID NO: 14656

SEQ ID NO: 14665 - RNA, 62 nt, Human; identical to SEQ ID NO: 12015

SEQ ID NO: 14666 - RNA, 58 nt, Human; identical to SEQ ID NO: 14656

SEQ ID NO: 14667 - RNA, 62 nt, Human; identical to SEQ ID NO: 12015

SEQ ID NO: 14668 - RNA, 58 nt, Human; identical to SEQ ID NO: 14656

SEQ ID NO: 14669 - RNA, 62 nt, Human; identical to SEQ ID NO: 12015

SEQ ID NO: 14670 - RNA, 58 nt, Human; identical to SEQ ID NO: 14656

SEQ ID NO: 14671 - RNA, 62 nt, Human; identical to SEQ ID NO: 12015

SEQ ID NO: 14672 - RNA, 58 nt, Human; identical to SEQ ID NO: 14656

SEQ ID NO: 14673 - RNA, 62 nt, Human; identical to SEQ ID NO: 12015

SEQ ID NO: 14674 - RNA, 58 nt, Human; identical to SEQ ID NO: 14656

SEQ ID NO: 14675 - RNA, 62 nt, Human; identical to SEQ ID NO: 12015

SEQ ID NO: 14676 - RNA, 58 nt, Human; identical to SEQ ID NO: 14656

SEQ ID NO: 14677 - RNA, 62 nt, Human; identical to SEQ ID NO: 12015

SEQ ID NO: 14678 - RNA, 58 nt, Human; identical to SEQ ID NO: 14656

SEQ ID NO: 14679 - RNA, 62 nt, Human; identical to SEQ ID NO: 12015

SEQ ID NO: 14680 - RNA, 58 nt, Human; identical to SEQ ID NO: 14656

SEQ ID NO: 14681 - RNA, 62 nt, Human; identical to SEQ ID NO: 12015

SEQ ID NO: 14682 - RNA, 58 nt, Human; identical to SEQ ID NO: 14656

SEQ ID NO: 14683 - RNA, 62 nt, Human; identical to SEQ ID NO: 12015

SEQ ID NO: 14684 - RNA, 58 nt, Human; identical to SEQ ID NO: 14656

SEQ ID NO: 14685 - RNA, 62 nt, Human; identical to SEQ ID NO: 12015

SEQ ID NO: 14686 - RNA, 58 nt, Human; identical to SEQ ID NO: 14656

SEQ ID NO: 14687 - RNA, 62 nt, Human; identical to SEQ ID NO: 12015

SEQ ID NO: 14688 - RNA, 58 nt, Human; identical to SEQ ID NO: 14656

SEQ ID NO: 14689 - RNA, 62 nt, Human; identical to SEQ ID NO: 12015

SEQ ID NO: 14690 - RNA, 58 nt, Human; identical to SEQ ID NO: 14656

SEQ ID NO: 14691 - RNA, 62 nt, Human; identical to SEQ ID NO: 12015

SEQ ID NO: 14692 - RNA, 58 nt, Human; identical to SEQ ID NO: 14656

SEQ ID NO: 14693 - RNA, 62 nt, Human; identical to SEQ ID NO: 12015

SEQ ID NO: 14694 - RNA, 58 nt, Human; identical to SEQ ID NO: 14656

SEQ ID NO: 14695 - RNA, 62 nt, Human; identical to SEQ ID NO: 12015

SEQ ID NO: 14696 - RNA, 58 nt, Human; identical to SEQ ID NO: 14656

SEQ ID NO: 14697 - RNA, 62 nt, Human
ccaccucacuuggcccaauuuuaacuuaauuaucucugucaagagccuaucuccauauacag

SEQ ID NO: 14698 - RNA, 60 nt, Human
uucuuucuaaauguuauucauagucucaaguauagcgagagcuugguuuuauuugucauc

SEQ ID NO: 14699 - RNA, 62 nt, Human
auaugaaaagcucaggaucuaaugcaaaaauaaaacgguagaauuuuacucauccaaacagu

SEQ ID NO: 14700 - RNA, 60 nt, Human
ugauugccauuuguagaggggaaggaaucaagggacuuuaagcuagaucaaaaucugggg

SEQ ID NO: 14701 - RNA, 62 nt, Human
uccacagcacugccugcugggcugggacauuuuuccuccgaagucugagaaaagcucagccc

SEQ ID NO: 14702 - RNA, 62 nt, Human
aacccggcagacgggugcaggcccggccuuuccccacgcggacuccgcgcgaccccggcccu

SEQ ID NO: 14703 - RNA, 62 nt, Human
uuggucuauaauugcagauguuauuguaugaauguaccauaauauauuugagcagucccugc

SEQ ID NO: 14704 - RNA, 61 nt, Human
ugaaacugugucucuguagcaaugagugauacugugacaaaaccauccuugcauucuuccu

SEQ ID NO: 14705 - RNA, 62 nt, Human
uguaauauuugaauuuuuacauuuguuguacaaucaggaaaagcaauaaagauuuuucaaaa

SEQ ID NO: 14706 - RNA, 61 nt, Human
gaaugcuuuauauucuuucugcuguaaauuaaaaaugaagaaaauuuccccauacuacgug

SEQ ID NO: 14707 - RNA, 62 nt, Human
cuuauuccucccucauaccuagccauuucuccaaggcgcaaauggcccuggcuucauuuauu

SEQ ID NO: 14708 - RNA, 62 nt, Human
ggucucaagaggaagaacugucugucauuucgguaaguaggauacugugaggaagaccaaaa

SEQ ID NO: 14709 - RNA, 62 nt, Human
guauuuguacuaauucugauucuuuugcuguauagccuuagaugugcaaugcagacacuauc

SEQ ID NO: 14710 - RNA, 56 nt, Human
ggagcgggaccuguggcucuacaacugaguccuuaaacagggcaucuccaggaagg

SEQ ID NO: 14711 - RNA, 62 nt, Human
cuggcaggagggggugggaaugcaggccaggaggacgugguaggagggggagucugccagag

SEQ ID NO: 14712 - RNA, 62 nt, Human; identical to SEQ ID NO: 11407

SEQ ID NO: 14713 - RNA, 62 nt, Human
uuuuaccugugaagugaaauucuuucauuggggguaaggguaugaggugaucaggaaguuuc

SEQ ID NO: 14714 - RNA, 62 nt, Human
aaguucucuuccaggcacuuggacacuaaaaucuacuauguaggugcaaacuauuuuucucu

SEQ ID NO: 14715 - RNA, 62 nt, Human
acauaaugaggagccaaagaaaucugauguuuuuaacaauuaaacugcuaauguuaaauuga

SEQ ID NO: 14716 - RNA, 62 nt, Human; identical to SEQ ID NO: 10888

SEQ ID NO: 14717 - RNA, 62 nt, Human; identical to SEQ ID NO: 9407

SEQ ID NO: 14718 - RNA, 61 nt, Human
agauuuggcucuaccuuggaucugcuaguaaauaacuaauaggcaggcaguuauuugggua

SEQ ID NO: 14719 - RNA, 62 nt, Human
cgauccuggagcccccgcaccgguaccacauccaccggcgaaagagcuuugacgccucugac

SEQ ID NO: 14720 - RNA, 62 nt, Human; identical to SEQ ID NO: 12882

SEQ ID NO: 14721 - RNA, 62 nt, Human
caacaauucuguagccucaaguaagaccaccugugaacuugaucauuaucuggcccaaauau

SEQ ID NO: 14722 - RNA, 62 nt, Human
gagaaaucuuacagaaaacaggggugggaaucucuuccgauagagucgcuauuucugguuaa

SEQ ID NO: 14723 - RNA, 62 nt, Human
agucccguggcagagccuucugggcgcugcgggaacaggagauccucugucgccccugugag

SEQ ID NO: 14724 - RNA, 58 nt, Human; identical to SEQ ID NO: 11224

SEQ ID NO: 14725 - RNA, 62 nt, Human; identical to SEQ ID NO: 10891

SEQ ID NO: 14726 - RNA, 61 nt, Human
cuccaccccugccucccuccugccccugcucccggggaggaaaggcuaaagcugcuggccc

SEQ ID NO: 14727 - RNA, 62 nt, Human
uguuuucuaagugguaugugagauuuucuaauguaguuagaaguuucauugucugauggaca

SEQ ID NO: 14728 - RNA, 62 nt, Human
gcaacaacaacacacacgcacacacgcacacacacacacguacacacacauacaaaaucccu

SEQ ID NO: 14729 - RNA, 62 nt, Human
ugauuaaguaccgguacaucccguucacacaugggaagagaagguacagaggcaaggaggau

SEQ ID NO: 14730 - RNA, 62 nt, Human
cgaggagucggugugaggccgcgugcgucucugucguggacacgcgugauugacccuuuaac

SEQ ID NO: 14731 - RNA, 62 nt, Human; identical to SEQ ID NO: 12015

SEQ ID NO: 14732 - RNA, 58 nt, Human; identical to SEQ ID NO: 14656

SEQ ID NO: 14733 - RNA, 62 nt, Human; identical to SEQ ID NO: 12015

SEQ ID NO: 14734 - RNA, 58 nt, Human; identical to SEQ ID NO: 14656

SEQ ID NO: 14735 - RNA, 62 nt, Human; identical to SEQ ID NO: 12015

SEQ ID NO: 14736 - RNA, 58 nt, Human; identical to SEQ ID NO: 14656

SEQ ID NO: 14737 - RNA, 62 nt, Human
auuugaaaccauaaaguguucugaagaaauuaagucuauaaaaagcauacuuucuuuuuucu

SEQ ID NO: 14738 - RNA, 60 nt, Human
uacaaaaggugauugcaccacuuaaaaaaggauagguagaaaaucuggccauuuuaugug

SEQ ID NO: 14739 - RNA, 62 nt, Human; identical to SEQ ID NO: 11831

SEQ ID NO: 14740 - RNA, 62 nt, Human
uuauuuccuccuuaacaguauuuuuggcauuagacauucuuauugugaagaaauaauguuaa

SEQ ID NO: 14741 - RNA, 62 nt, Human
ucaggauccacagcuuaaagaugggaauucagguaugaaagaaaacaggcaaggaggcacug

SEQ ID NO: 14742 - RNA, 62 nt, Human
cugacugcuggcuggcgaggaggcugcgagcguggaaucggaagcgaccgcgggcuuuuuug

SEQ ID NO: 14743 - RNA, 62 nt, Human
acacagaaacauucgcagccugcgguaggcucccccuuccuaaacccuuaaaugcccuuagu

SEQ ID NO: 14744 - RNA, 60 nt, Human
auuuuguauuuuuaguagagacgggauuucuccauguugaucaggcuggucaugaacucc

SEQ ID NO: 14745 - RNA, 62 nt, Human
cugacuuaggcaauacaccaagggcgagauuuuauaugcacauuucuggauuuuuuuauacg

SEQ ID NO: 14746 - RNA, 59 nt, Human
ccucagagaaccuaaaacuagugcacauugucugccauaagaaaaccacccacaagcuc

SEQ ID NO: 14747 - RNA, 62 nt, Human
caggcuacagaggggccagcuccagaacagugaccagcuacauccuguccaagcagcccgag

SEQ ID NO: 14748 - RNA, 61 nt, Human
uuuuuuuuaacuuaagaggauucaggguuaagcaccaacuaaauuaaaucaugcuauuuaa

SEQ ID NO: 14749 - RNA, 62 nt, Human
uugcucacuguugggcccucagggcgggcaggguggcugugagucccaggugucaucuuccu

SEQ ID NO: 14750 - RNA, 61 nt, Human
cggggagcaggcugcugcugcugacucugugcagcugcgcaccugugucccccaccuccac

SEQ ID NO: 14751 - RNA, 62 nt, Human
ggcagucuucaugcugcccugcugcugcuggaaggauggggaucuuucaccuuuagggaucu

SEQ ID NO: 14752 - RNA, 61 nt, Human
cuucggcccagaccacagcgucuugcccugagccuagagcagggagucccgaacuucugca

SEQ ID NO: 14753 - RNA, 62 nt, Human
ccuccucugugggccuggcagacccuucaugagugggacccaagauaucacugacuucaacc

SEQ ID NO: 14754 - RNA, 59 nt, Human
gucgcucuuccugcggguucuuggcgagacacagcuugagaacagaagggcgucggggg

SEQ ID NO: 14755 - RNA, 62 nt, Human; identical to SEQ ID NO: 14753

SEQ ID NO: 14756 - RNA, 59 nt, Human; identical to SEQ ID NO: 14754

SEQ ID NO: 14757 - RNA, 62 nt, Human
uucguccuugucacaguagcuugggaugacucccaguccacauggaaaacaucagggaguga

SEQ ID NO: 14758 - RNA, 62 nt, Human
cgcuggggccgccgcacccugcaccuuggaccggcauccguagccauggacagaggucccug

SEQ ID NO: 14759 - RNA, 62 nt, Human
uuguuaacuuuuuauauuaaugacuauugaaagugguaauaaaaauuuauauuauaggcuuc

SEQ ID NO: 14760 - RNA, 58 nt, Human
cugugccuggguguauucuuuauacuguagauaauggagaaauuuucuaucucugucc

SEQ ID NO: 14761 - RNA, 62 nt, Human; identical to SEQ ID NO: 9881

SEQ ID NO: 14762 - RNA, 60 nt, Human
gacagucucccugauggacccucagucuucucaugaauaaauuccuucaacgccuguguu

SEQ ID NO: 14763 - RNA, 62 nt, Human
acugcuacaugccggccaauaucgagcaggagcuccgggucauggaguuccugaagcagaag

SEQ ID NO: 14764 - RNA, 58 nt, Human
cccuggggacccuaacaggcccagagcagagccccuuaccucccaggucagacuaccu

SEQ ID NO: 14765 - RNA, 62 nt, Human; identical to SEQ ID NO: 14763

SEQ ID NO: 14766 - RNA, 58 nt, Human; identical to SEQ ID NO: 14764

SEQ ID NO: 14767 - RNA, 62 nt, Human; identical to SEQ ID NO: 14763

SEQ ID NO: 14768 - RNA, 58 nt, Human; identical to SEQ ID NO: 14764

SEQ ID NO: 14769 - RNA, 62 nt, Human; identical to SEQ ID NO: 13704

SEQ ID NO: 14770 - RNA, 61 nt, Human
ugagcccaggggacucagugcccuccaugcccuggcuggcagaaacccucaacagcagucu

SEQ ID NO: 14771 - RNA, 62 nt, Human
cuggaucuuguagugggugcacacgcgugcacugggaccccacacagcaauacgaguccaac

SEQ ID NO: 14772 - RNA, 55 nt, Human
gggccaugccauggcagauaaagcucaggacgucaaaaacucaccauggacccca

SEQ ID NO: 14773 - RNA, 62 nt, Human
agggaccuuugauaggcuacgauacuauuuuccugugcaucacacuuaacucaucuaacugc

SEQ ID NO: 14774 - RNA, 61 nt, Human
uaagaaaccacuauuauauauuuuuucccuucagucacauagacuucagacaacucuccua

SEQ ID NO: 14775 - RNA, 62 nt, Human
gucuggcgcccaugaugggagggauugacauguuucaacaaaauaaugcacuuccuuaccua

SEQ ID NO: 14776 - RNA, 60 nt, Human
cugucaacaaaugauaccuuuggauauccauccuccucgacuuauaguacagugguguau

SEQ ID NO: 14777 - RNA, 62 nt, Human; identical to SEQ ID NO: 14625

SEQ ID NO: 14778 - RNA, 62 nt, Human
acaagccgggcgauuuguuuguaacuagcagugggagaucaaguuggggaacagauggcuga

SEQ ID NO: 14779 - RNA, 62 nt, Human
auuuaaaggaagaaaucagaguugcuauaaaauucaguaaaaagcucauagccaaacggcug

SEQ ID NO: 14780 - RNA, 59 nt, Human
gcuuggcagcugggggugaggagacaacaaaccucgggaacuggagccagagcugcggc

SEQ ID NO: 14781 - RNA, 62 nt, Human; identical to SEQ ID NO: 14435

SEQ ID NO: 14782 - RNA, 57 nt, Human
uuuuaauuacaauaaugaguucacuacagacgauuaacacaccacacuggcgaacca

SEQ ID NO: 14783 - RNA, 62 nt, Human
caaccugccccacugggucccggcaggggccaugccuaccaagcucgagcuggcccuugacc

SEQ ID NO: 14784 - RNA, 61 nt, Human
agcuucaaugauuuguaacugaaauaucagguucuagaagaaacuggcgcuuaaaccaaau

SEQ ID NO: 14785 - RNA, 62 nt, Human
gaaauguuauguuucuuaugacuuguuuccacuccucguacaaugcuauucuuagguuucua

SEQ ID NO: 14786 - RNA, 60 nt, Human
gugggaucaugggcagggaaggcucugggggucggagacaccgcugcuuagcacccccag

SEQ ID NO: 14787 - RNA, 62 nt, Human
gcaugucccuucacauaauugauaaugguaccaccuucuauaauaauaauauaaaauaaaaa

SEQ ID NO: 14788 - RNA, 62 nt, Human
guuauuggcaaaaagcaugagagaauaagaacggcgguaacaaaagacaaugaguuaaggga

SEQ ID NO: 14789 - RNA, 62 nt, Human
gccgguccaagccuguggcuggagcuggggucuguuuaccuaauaaagucccacaggugccu

SEQ ID NO: 14790 - RNA, 60 nt, Human
gccccuaugagaaggugagacccuagcaguaccgaucguaacccaugggcgcuaugugcc

SEQ ID NO: 14791 - RNA, 62 nt, Human
uaagaggaagauucaauauuaacuagcuugaagccugaccuagccagaagugccuguccgcu

SEQ ID NO: 14792 - RNA, 58 nt, Human
gagggcucugacauucuuuuuaaaaacaccacaaagcaaaauucccaggacaugugua

SEQ ID NO: 14793 - RNA, 49 nt, Human
gcacaauguacuucgcuuaaauaguccaaguauauucucugagaggaag

SEQ ID NO: 14794 - RNA, 60 nt, Human
ucccugccuggagcacacuuuagaauucugaagaugugaagccucugucucacugaggau

SEQ ID NO: 14795 - RNA, 62 nt, Human
cagcuuaaaguuguguaauacuaaaaucacgagaacaccuaaacaacaaccaaaaaucuauu

SEQ ID NO: 14796 - RNA, 62 nt, Human
ggcugaauucccuuuuuccuuuacucaauaaaagcuacaucagacugaugcucuuucuccag

SEQ ID NO: 14797 - RNA, 62 nt, Human; identical to SEQ ID NO: 14409

SEQ ID NO: 14798 - RNA, 58 nt, Human
cgaaagaguaaggugugugcuuuuuuuuuuuugcaauaugaccccgucucucugaagu

SEQ ID NO: 14799 - RNA, 62 nt, Human
cauuuauagagaaugagggcugauaacaggaauacaguggcaaagacuagacuguggaaagg

SEQ ID NO: 14800 - RNA, 59 nt, Human
uugaggguucauuaaauugcaugaauagagacgggucaaauaaauaggcaaaagggauu

SEQ ID NO: 14801 - RNA, 62 nt, Human
gcuccggggaaauuguuaaagccccggggcuggggacgcggaggaguuggcagaguuucucu

SEQ ID NO: 14802 - RNA, 61 nt, Human
cuuggcgagacacagcuugagaacagaagggcgucgggggaaccugccgcaaggagcagag

SEQ ID NO: 14803 - RNA, 62 nt, Human
agaaacaggccagauaaguguguuguuuuuuauuaccgccgacuacuguaggagauagguac

SEQ ID NO: 14804 - RNA, 55 nt, Human
ccugcagaggggaaaccaguguagccuugcccggauucugggaggaagcagguug

SEQ ID NO: 14805 - RNA, 62 nt, Human
uguguacuuaguguguaugugauccuccaguguuaucccggagauggauugaugucuccauu

SEQ ID NO: 14806 - RNA, 61 nt, Human
uauaaauauccccagggacagaaaccaaggccccgagcucagggcagcugugcugggugag

SEQ ID NO: 14807 - RNA, 62 nt, Human
ucugacuuuagccucgugcugagccguguauccaugcagucauguucacgugcuaguuacgu

SEQ ID NO: 14808 - RNA, 58 nt, Human
gccggcagggugcuucgggagcccccugcuacggggaaaggcauguguuucuugcugg

SEQ ID NO: 14809 - RNA, 62 nt, Human
uuuguuccuuucagauccuccacuuggcaggcagggccaacagcagcccccgggccaggugu

SEQ ID NO: 14810 - RNA, 62 nt, Human
ucuuggccaccuuucccuggggacccuaacaggcccagagcagagccccuuaccucccaggu

SEQ ID NO: 14811 - RNA, 62 nt, Human
aggagcuggugacauucugaugcuggaggcaggugacggggagcacagacuuuguguccugc

SEQ ID NO: 14812 - RNA, 59 nt, Human
cucacucccaguucccuggacagagcuaaacucucgagacuucucugugaacuucccua

SEQ ID NO: 14813 - RNA, 62 nt, Human
aagcugaugccaaacaucuuuacagaggaacuguaguucacauccaccugucugacauuguc

SEQ ID NO: 14814 - RNA, 62 nt, Human
guggaggcuugagaauacuugagggaguuacucuuggaugcaugguuguaaagaaacaauca

SEQ ID NO: 14815 - RNA, 62 nt, Human
gcccgcaggcgugucugugcgugugggcgugugugcaagcgagcgugggugcgcguguggcc

SEQ ID NO: 14816 - RNA, 62 nt, Human; identical to SEQ ID NO: 13282

SEQ ID NO: 14817 - RNA, 62 nt, Human
gcaggacaggcaggagagauucuuccuaaagccucccccauaaaaagggagcuguggaucca

SEQ ID NO: 14818 - RNA, 61 nt, Human
gacguccccacccguuccugcucucauccccagguugggcacgugggguuccuccucugug

SEQ ID NO: 14819 - RNA, 62 nt, Human
ugacaaaggcagcacuuauuuccugggcuggugcgccccaaaacacggccccgacacuuagu

SEQ ID NO: 14820 - RNA, 61 nt, Human
agcgucucugcucacuuagcuggcagugccuguccccagcagccagcaaaggcccggacgg

SEQ ID NO: 14821 - RNA, 62 nt, Human; identical to SEQ ID NO: 10372

SEQ ID NO: 14822 - RNA, 60 nt, Human
uuggccgaaggacuuuuaucugucuuggucaccccggccaggccccggaagcagcagcca

SEQ ID NO: 14823 - RNA, 62 nt, Human; identical to SEQ ID NO: 10372

SEQ ID NO: 14824 - RNA, 60 nt, Human; identical to SEQ ID NO: 14822

SEQ ID NO: 14825 - RNA, 62 nt, Human
cuugaaucugcucccugaacuuccugccagugccuccccguaccccaaaacaaugucaccau

SEQ ID NO: 14826 - RNA, 60 nt, Human
augcagccucacagaagcagccucugccuccacuuuaccagcuacguuuuuaucuuaagc

SEQ ID NO: 14827 - RNA, 62 nt, Human
cgguggucccagcuucuuggcuuggaggcugagguaggaggaucgccugagcaugggaggca

SEQ ID NO: 14828 - RNA, 62 nt, Human
uguggucaugugcuccuagcugcacgguggcugcuggccacaccacggcaaguggcagcagg

SEQ ID NO: 14829 - RNA, 62 nt, Human; identical to SEQ ID NO: 14603

SEQ ID NO: 14830 - RNA, 62 nt, Human
caggcgaggauaagcuaacgaugcugcuguggccucuaugcacucagcaagagcgggacgcc

SEQ ID NO: 14831 - RNA, 62 nt, Human
uuaaggagcuguaaggccucucgagcauccaaacccucacgaccugcaaggggccagcaggg

SEQ ID NO: 14832 - RNA, 62 nt, Human; identical to SEQ ID NO: 14702

SEQ ID NO: 14833 - RNA, 62 nt, Human; identical to SEQ ID NO: 9258

SEQ ID NO: 14834 - RNA, 62 nt, Human
gaagagagggacagaccgucagaaacuggagaguuucuauuaaaggucauuuaaaccacuga

SEQ ID NO: 14835 - RNA, 62 nt, Human; identical to SEQ ID NO: 10660

SEQ ID NO: 14836 - RNA, 62 nt, Human
auauucaacuuucauggacugccccuggcaagguccucgauaaaggaagagguaaguuugac

SEQ ID NO: 14837 - RNA, 62 nt, Human; identical to SEQ ID NO: 12655

SEQ ID NO: 14838 - RNA, 62 nt, Human; identical to SEQ ID NO: 11862

SEQ ID NO: 14839 - RNA, 62 nt, Human
cggguaccaggaagugcagagccgcacaggagcugccccggagcugaggggacggucuucgg

SEQ ID NO: 14840 - RNA, 62 nt, Human
gccacaccccaggcccugcgaggggcuaucgagaggagcucacugugggaugggguugaccu

SEQ ID NO: 14841 - RNA, 62 nt, Human
ggcuuuguccuccaggaggugggggaaugugguaacauugaauacaguugaauaaaaucgcu

SEQ ID NO: 14842 - RNA, 62 nt, Human; identical to SEQ ID NO: 12389

SEQ ID NO: 14843 - RNA, 62 nt, Human; identical to SEQ ID NO: 14841

SEQ ID NO: 14844 - RNA, 62 nt, Human; identical to SEQ ID NO: 12389

SEQ ID NO: 14845 - RNA, 62 nt, Human; identical to SEQ ID NO: 14836

SEQ ID NO: 14846 - RNA, 61 nt, Human
gggcagagugugguaugucagggugugccgguuuuagguaacaagacuccaccacugagug

SEQ ID NO: 14847 - RNA, 62 nt, Human
ugagauggcaugugaaagcacuuugaaaauuguaaagcgcuauguaaauguaagguauuaua

SEQ ID NO: 14848 - RNA, 60 nt, Human
gagugcaucggauggcuucuggaaaucuguggccacucgagugcccaaggagcccccuga

SEQ ID NO: 14849 - RNA, 62 nt, Human
ucucacuucugagaacgaaacuggucccucgaaaucguggcacccgcggcgccgccuccucc

SEQ ID NO: 14850 - RNA, 62 nt, Human
ccucuuacuauuucuuagugagaugagaaacccucgguccgacgagaugagauuucccauac

SEQ ID NO: 14851 - RNA, 62 nt, Human; identical to SEQ ID NO: 11505

SEQ ID NO: 14852 - RNA, 62 nt, Human; identical to SEQ ID NO: 9748

SEQ ID NO: 14853 - RNA, 62 nt, Human
gcaccuuggagggugggcaggacacaguugauugucucuacagagcugugacgggggcacug

SEQ ID NO: 14854 - RNA, 58 nt, Human
cuggccaauauggugaaaccccaucucuacuaagaauacaaaaaauuagcugagcaug

SEQ ID NO: 14855 - RNA, 62 nt, Human; identical to SEQ ID NO: 11507

SEQ ID NO: 14856 - RNA, 62 nt, Human
uuaacuaccaugauugcuuuugagggcccggaauuauaaauauauauuauauuuuaauuguu

SEQ ID NO: 14857 - RNA, 62 nt, Human
uaaagcacaaaauuggugccaagacugggugagaaauguacauuacccccuuauuauuuuga

SEQ ID NO: 14858 - RNA, 62 nt, Human
agagacccaagcugccuccccucuccuuccuguguguccaaaacugccucaggaggcaggac

SEQ ID NO: 14859 - RNA, 62 nt, Human
uuccgacuuuuccaauggaaacucagaucccaaaagucccuaaagcagucguagagucucac

SEQ ID NO: 14860 - RNA, 62 nt, Human
ucugagaagcacagcuaccugccuucacugaaauauaccucaggcugaaauuugggguggga

SEQ ID NO: 14861 - RNA, 62 nt, Human; identical to SEQ ID NO: 10492

SEQ ID NO: 14862 - RNA, 62 nt, Human
auuuguuguacaaucaggaaaagcaauaaagauuuuucaaaaauagacaugucaagaaaguu

SEQ ID NO: 14863 - RNA, 62 nt, Human; identical to SEQ ID NO: 9957

SEQ ID NO: 14864 - RNA, 60 nt, Human
uuuguaauauacagcuuuuuuuuuaaggcaucauuuucgagggucuaaaauuaucuggua

SEQ ID NO: 14865 - RNA, 62 nt, Human
ggagagaggaggguggugccauaccugcugcaucaggcaucaaaaucccccgucaguucccc

SEQ ID NO: 14866 - RNA, 60 nt, Human
cacguugaaccacgugaaacugcuguuuucuaggccaaaaauggugagcgaucauuuauu

SEQ ID NO: 14867 - RNA, 62 nt, Human
guagaaaggaagcacuucugagccagugaccacugaaagguaugugcuaugauaaagcagau

SEQ ID NO: 14868 - RNA, 61 nt, Human
uuccuaacgcaaacuacaauaaauggugacacacguucagaagaaaucuucuuugagucuc

SEQ ID NO: 14869 - RNA, 62 nt, Human
cucaaacucugauucccacuccacucuucgagguuucucucagcuuuuugaccuggcucccu

SEQ ID NO: 14870 - RNA, 62 nt, Human; identical to SEQ ID NO: 9249

SEQ ID NO: 14871 - RNA, 62 nt, Human; identical to SEQ ID NO: 11844

SEQ ID NO: 14872 - RNA, 62 nt, Human; identical to SEQ ID NO: 10083

SEQ ID NO: 14873 - RNA, 62 nt, Human; identical to SEQ ID NO: 11235

SEQ ID NO: 14874 - RNA, 61 nt, Human
gauacaacugagcuacaggcaagaggauacuaccgggcgcaguggcucacaccuguaaucc

SEQ ID NO: 14875 - RNA, 62 nt, Human
gggugaacucccuggaccuuuccuagccagccgcacagucuaggcccuuguggggugaagaa

SEQ ID NO: 14876 - RNA, 62 nt, Human; identical to SEQ ID NO: 14128

SEQ ID NO: 14877 - RNA, 62 nt, Human
uuuuuuuuccucauuuuucuuaaauccaaguuggccguuuuauuaguauguuucaaaugugu

SEQ ID NO: 14878 - RNA, 61 nt, Human
acagaaaccacagaaauauucccuuagaauaaaauaguauauuuguauuugaugggugagu

SEQ ID NO: 14879 - RNA, 62 nt, Human
ccacuuuuccugcauuguggagcugacugaguacaccggugaggcuggggucucugcagggg

SEQ ID NO: 14880 - RNA, 62 nt, Human
uucggcuccucugcaccccgugauucugcccacgcuccuccaccacgaggcacugaccugcg

SEQ ID NO: 14881 - RNA, 62 nt, Human
uuacuuccuuucacugccaaccucgaauuacuguacaguauaugucuuucugcuugugauca

SEQ ID NO: 14882 - RNA, 62 nt, Human; identical to SEQ ID NO: 14046

SEQ ID NO: 14883 - RNA, 62 nt, Human
gggggccgggccugcaagagcccgaaaggucgccacccccuagccuguggggugcaucugcg

SEQ ID NO: 14884 - RNA, 62 nt, Human
gcccacccucgucucugccugggugagcccaccccggcuguaucucaggucuggguccuccc

SEQ ID NO: 14885 - RNA, 62 nt, Human
cggagacuuggcagagagacucaagcugauugucacaggcuacagaggggccagcuccagaa

SEQ ID NO: 14886 - RNA, 62 nt, Human
gguaucuucucagugagcauagguuggggacugugaucuugagaagccaugggccagcaaua

SEQ ID NO: 14887 - RNA, 62 nt, Human
agggugggggugccuagccaggugcaguccccgccccgccuaguccucggcgucacgcaaug

SEQ ID NO: 14888 - RNA, 62 nt, Human
ccccaccccacucuuacccaauuucugggcucuggauccucacagucauggaggcaccgugg

SEQ ID NO: 14889 - RNA, 62 nt, Human; identical to SEQ ID NO: 14887

SEQ ID NO: 14890 - RNA, 62 nt, Human; identical to SEQ ID NO: 14888

SEQ ID NO: 14891 - RNA, 62 nt, Human
ggaaggacggaugcauugcgauucugcuuacacaucggguuaucaaagcgagucacuuguug

SEQ ID NO: 14892 - RNA, 55 nt, Human
gcacggaugcugugacugcccuuccuugcgugucaugggauuaccgaagaguccc

SEQ ID NO: 14893 - RNA, 62 nt, Human
uaauuuccaaacccguuuguucucagauaaaaagcaguuuuauaaacccgcaaucugcucca

SEQ ID NO: 14894 - RNA, 62 nt, Human; identical to SEQ ID NO: 11148

SEQ ID NO: 14895 - RNA, 62 nt, Human
acagauuugguuuaguuuuguuuuguuuuguuuuuucuuuuagaacuguauaguauugaaaa

SEQ ID NO: 14896 - RNA, 61 nt, Human
gcaccucugacauuccuuuuauuaacucaccucucaguugaaagauuucuucuuugaaagg

SEQ ID NO: 14897 - RNA, 62 nt, Human
uuugccgacguccuggugcaccgccuccuggcugccgcguuaggugaggggugcagucgggg

SEQ ID NO: 14898 - RNA, 60 nt, Human
auuagguguguccagcuucuuggccaccuuucccuggggacccuaacaggcccagagcag

SEQ ID NO: 14899 - RNA, 62 nt, Human
gcuuagcggucauuaucgugucuguuggugaaauuuuuauuaaaaggaaaauucuguagaug

SEQ ID NO: 14900 - RNA, 60 nt, Human
ugaagagagggacagaccgucagaaacuggagaguuucuauuaaaggucauuuaaaccac

SEQ ID NO: 14901 - RNA, 62 nt, Human
uugaacucuucagacuuuuuaacaugccccugugaacagguauuuucaggacucaaacuacc

SEQ ID NO: 14902 - RNA, 57 nt, Human
acacccaggaggaauugaaagaggcuuccucuucucaggaagaagccauuuccuucu

SEQ ID NO: 14903 - RNA, 62 nt, Human
ccccaguucaucccaaccccucucagagccucaagagggguagcucggcugccggaagagag

SEQ ID NO: 14904 - RNA, 62 nt, Human
uuucuuugaagcauuuacuuagcucaagucugaagcuguagauacuggaagacaaugcaccu

SEQ ID NO: 14905 - RNA, 62 nt, Human; identical to SEQ ID NO: 10230

SEQ ID NO: 14906 - RNA, 62 nt, Human
gugacaaagcagugcaguuggauuguaaggaaaaauuccggaauuaaugcauccuaaugaau

SEQ ID NO: 14907 - RNA, 62 nt, Human
gagugcugggggaggccauccaagauggcaugaaucgggcuaaggucccugggggugcagau

SEQ ID NO: 14908 - RNA, 60 nt, Human
cucguuuccccagugucauucaauaugcucuaaacgacgagguaaugcugaggcuauugc

SEQ ID NO: 14909 - RNA, 62 nt, Human
cggcuucaaauagaugccgccccugcccgcgcuuugcagcuagucccugcaaaccuugauga

SEQ ID NO: 14910 - RNA, 61 nt, Human; identical to SEQ ID NO: 13219

SEQ ID NO: 14911 - RNA, 62 nt, Human
cugccgagugaacccucugucccugagcuaacccacauacuagcagaggaggaagucagagu

SEQ ID NO: 14912 - RNA, 62 nt, Human
acaacugaagagguaacuaaaucucacaugcaggucuaaugacuaauaauuggaguacggcu

SEQ ID NO: 14913 - RNA, 50 nt, Human; identical to SEQ ID NO: 13359

SEQ ID NO: 14914 - RNA, 55 nt, Human
cggaucacagugaaagggauuccucccacgccagaucugcacaacgaggcaagac

SEQ ID NO: 14915 - RNA, 62 nt, Human
ucacaguucagcgggaggcuuuccguacccacacuggcuguagccacuucaguccaucugcc

SEQ ID NO: 14916 - RNA, 62 nt, Human
gguggcgaccagcccagaagaggcccacccucucgguccggaacaagacgccucggccacgg

SEQ ID NO: 14917 - RNA, 62 nt, Human
uacuaucuugggccagaacuaagaaugccaagguuuuauauauguguguguauauauauaua

SEQ ID NO: 14918 - RNA, 62 nt, Human
acugugccuggguguauucuuuauacuguagauaauggagaaauuuucuaucucugucccua

SEQ ID NO: 14919 - RNA, 62 nt, Human
cagggagagcaggauccucuucagcaccuggaaccuggaucacauguaagcucacagagcga

SEQ ID NO: 14920 - RNA, 55 nt, Human
acauuuacacuuuuguuauaagcuauuuaaaaccaguaaggagacuugaaauuca

SEQ ID NO: 14921 - RNA, 62 nt, Human
ccagcagguccggcugcccggugcgccagaucucccgcaggauccguucgcgcuccuccagc

SEQ ID NO: 14922 - RNA, 62 nt, Human
gcaaggcugugcucuuccucugguuucuguguguccguuugagugucugcgccccgccuccc

SEQ ID NO: 14923 - RNA, 62 nt, Human
ucccgugaggcugcacccguguggguagcacuggaagcggcacuguuugcauuguacauagg

SEQ ID NO: 14924 - RNA, 62 nt, Human
uuucaagcuucacuuuugugcaguagaaacaaaaguaggcuacagucugugccauguugaug

SEQ ID NO: 14925 - RNA, 62 nt, Human
cgucaggcgggacucgugucccagagaggaaggggcugcugaggucugauggggcccuuccu

SEQ ID NO: 14926 - RNA, 62 nt, Human
aaauagggcaaauaauuuugucuuuguauaauagauuugauauuuaaagucacuggaaauag

SEQ ID NO: 14927 - RNA, 62 nt, Human
gcgggacugaggcugccucacguguugcaagaacaguuuugagccauuguuaacaaugccuu

SEQ ID NO: 14928 - RNA, 52 nt, Human
gagauuucaggauaaguuacccccaggcccgaagccccagcuugcccuggcc

SEQ ID NO: 14929 - RNA, 62 nt, Human; identical to SEQ ID NO: 12370

SEQ ID NO: 14930 - RNA, 60 nt, Human
cuccguggcugccuccaugggacaaggaccgauuccaacacaggcuccucuuucccccuu

SEQ ID NO: 14931 - RNA, 62 nt, Human; identical to SEQ ID NO: 9466

SEQ ID NO: 14932 - RNA, 62 nt, Human
gaugguaaccucacugccccgucacucccuucaaaggcgacagacccaagcccacgucagga

SEQ ID NO: 14933 - RNA, 62 nt, Human
gguggcagcguggagggcucggcguggauggcagccucaggacacacaccccugccucaagg

SEQ ID NO: 14934 - RNA, 62 nt, Human
gagaugaauguuacagaauuggacaacccgaacugcuuuucaaaaccagaggaaggagguuc

SEQ ID NO: 14935 - RNA, 62 nt, Human; identical to SEQ ID NO: 11493

SEQ ID NO: 14936 - RNA, 59 nt, Human
caugugugaaguagcuagaaaaaauaacugucgcguacacucgaaaauaccuuacugua

SEQ ID NO: 14937 - RNA, 62 nt, Human; identical to SEQ ID NO: 9577

SEQ ID NO: 14938 - RNA, 62 nt, Human
gcucccccuucauucugaugccucccuggggaacaaggauaaugacuuugcaucugcaccug

SEQ ID NO: 14939 - RNA, 62 nt, Human
augcuuuagcccaaggacacaucaccaacccauggacucgcagacaccggggcuggguuucu

SEQ ID NO: 14940 - RNA, 60 nt, Human
caggugagggggcagcccacagaccugcuccucaguagcagggccuggccaggccccugc

SEQ ID NO: 14941 - RNA, 62 nt, Human
cugccuggucuccacaguagccucccugcccgggucccagcacccuggaugcccgucucugu

SEQ ID NO: 14942 - RNA, 62 nt, Human
gcccuugacccccacccacccccacccuugcuggcaggggcagggaccccagggggauugac

SEQ ID NO: 14943 - RNA, 62 nt, Human; identical to SEQ ID NO: 14941

SEQ ID NO: 14944 - RNA, 62 nt, Human; identical to SEQ ID NO: 14942

SEQ ID NO: 14945 - RNA, 62 nt, Human; identical to SEQ ID NO: 14941

SEQ ID NO: 14946 - RNA, 62 nt, Human; identical to SEQ ID NO: 14942

SEQ ID NO: 14947 - RNA, 62 nt, Human; identical to SEQ ID NO: 11003

SEQ ID NO: 14948 - RNA, 62 nt, Human; identical to SEQ ID NO: 12034

SEQ ID NO: 14949 - RNA, 62 nt, Human; identical to SEQ ID NO: 14490

SEQ ID NO: 14950 - RNA, 56 nt, Human
aaaauacaaaaaauuagccaggcauggugccgcauaacuauaaucccagcuacuug

SEQ ID NO: 14951 - RNA, 62 nt, Human; identical to SEQ ID NO: 9434

SEQ ID NO: 14952 - RNA, 60 nt, Human
gggucguggggaccaagcacauugguccuaaaggggcugaagagccugaacugcaccuaa

SEQ ID NO: 14953 - RNA, 62 nt, Human
uacauaagucauuuuccccuuagagugcuugaagaaaugccaccuacagguuguguacuuuu

SEQ ID NO: 14954 - RNA, 60 nt, Human
cuuuccacacaggauuccguuggugaaccuguaaaaacaaaacaaacaaaacaaaacaaa

SEQ ID NO: 14955 - RNA, 62 nt, Human
ugcugccugcgccagccccaggcugcugaggagcagaggccagaccagggccgaucugggug

SEQ ID NO: 14956 - RNA, 62 nt, Human
gucccuguuucccaagcucuuucuuucccccgcugaacgagagaucgggccccacaaacaca

SEQ ID NO: 14957 - RNA, 62 nt, Human; identical to SEQ ID NO: 10376

SEQ ID NO: 14958 - RNA, 58 nt, Human
ccacugcgcucggccucagauuccauauuugaacaccagcugauugagagaaggggaa

SEQ ID NO: 14959 - RNA, 62 nt, Human
cuucucggccccgccaccugcccagcgugcccuggcucuccagaaccuucuaucccacaguc

SEQ ID NO: 14960 - RNA, 59 nt, Human
cugaagccacccuccgcccggacucaacagccgccagcaagcucgccuggcagugcccc

SEQ ID NO: 14961 - RNA, 62 nt, Human; identical to SEQ ID NO: 12096

SEQ ID NO: 14962 - RNA, 60 nt, Human
guucgcgccauucaccugccucagccucuggaguagcugagacuacaggcgcccaccacc

SEQ ID NO: 14963 - RNA, 62 nt, Human
aaguggacaauugggggucacuggcagagacaguauugcccaaaauguucacagcaggaggc

SEQ ID NO: 14964 - RNA, 62 nt, Human
ugcgggcugcccugugggcuggugcuucaggaggaauccagagaaguguucagaugcccccc

SEQ ID NO: 14965 - RNA, 62 nt, Human
ccgauaaaauggccuuaaguguauuccugacaguuaaauucagaaacgugccaaauggaacu

SEQ ID NO: 14966 - RNA, 61 nt, Human
ccuaacagccacguucacauuuacguagcugguugcuuacaaacgggccugagccccuggu

SEQ ID NO: 14967 - RNA, 62 nt, Human
ucagccagcgggcccacacgucggaccccgguuggccaaucacaacaggggggcguggccuu

SEQ ID NO: 14968 - RNA, 58 nt, Human
ccacgccuuuggguugggugugucugaugucuugccaagcgccugguccuguccucuu

SEQ ID NO: 14969 - RNA, 62 nt, Human
ggaagccgagcucugaugaacuugagaauuacaccucucucaugccgaagaccgugguguuc

SEQ ID NO: 14970 - RNA, 60 nt, Human
cugugccaauaauaccauuaugugccauguacugacccgaaaggcucggccgcagagccg

SEQ ID NO: 14971 - RNA, 62 nt, Human; identical to SEQ ID NO: 9538

SEQ ID NO: 14972 - RNA, 59 nt, Human
ugaaaacacgagugugaaccucucuccccugcgucgccaccucuguaauugauguacau

SEQ ID NO: 14973 - RNA, 62 nt, Human
ccaauccugagaauaaccuccccuccagccagagauauuccaacucugcaauaaaacucucc

SEQ ID NO: 14974 - RNA, 62 nt, Human
aaauggcagaagggccccuccuuugggagaccuugucagucagcaucucuagggcaaccgug

SEQ ID NO: 14975 - RNA, 62 nt, Human; identical to SEQ ID NO: 9785

SEQ ID NO: 14976 - RNA, 62 nt, Human; identical to SEQ ID NO: 9594

SEQ ID NO: 14977 - RNA, 62 nt, Human
ucgcuguauuuaagaugcuggugaagagcuuuugcucuugcauuagauuugaagauguuuac

SEQ ID NO: 14978 - RNA, 62 nt, Human; identical to SEQ ID NO: 9831

SEQ ID NO: 14979 - RNA, 61 nt, Human
uggggaggccgaggcgggcagaucacgagaucaggaguucaagaccagccuggccaauaug

SEQ ID NO: 14980 - RNA, 62 nt, Human
ccucggggcggggguguguggucaggcugggcaccaggcacacagauguccguggcgugcgu

SEQ ID NO: 14981 - RNA, 60 nt, Human
cuaacacaagauggaacuugagcaaaauguggguacguuaaucuuuaauaaacuaacucc

SEQ ID NO: 14982 - RNA, 62 nt, Human
cugguuaauauacauauauaaauauauaaauacaaacacacacacacacuuuuuuuguacug

SEQ ID NO: 14983 - RNA, 62 nt, Human
cucuuuuuuaaaagacaaaagcaaaaccagacuuucuacguacuacuccaaagacugugauu

SEQ ID NO: 14984 - RNA, 62 nt, Human
guggcagaguuuggcugugaccuuugccccuaacacgaggaacucguuugaagggggcagcg

SEQ ID NO: 14985 - RNA, 60 nt, Human
cgucgugagggagcacuucccaggggccgcagggacgacacucuccagggaggccccagc

SEQ ID NO: 14986 - RNA, 62 nt, Human
accacuucuguauuguguggucuuaacugccuaaggcggcaaugggcagugggccccuuucc

SEQ ID NO: 14987 - RNA, 61 nt, Human
gggucucacucugucgcucaggcuggagugcagugaugcaaucuuggcucacugcaaccuc

SEQ ID NO: 14988 - RNA, 62 nt, Human
ugcugaauuguuuauaauggcaagaaauaggaaaccccccaaugucuguugaacagcuauca

SEQ ID NO: 14989 - RNA, 58 nt, Human
gggggccacucaggagaguuggguuuucagggcagagaugggcuugauuccaccuggu

SEQ ID NO: 14990 - RNA, 62 nt, Human; identical to SEQ ID NO: 10450

SEQ ID NO: 14991 - RNA, 62 nt, Human
accuauucuccacacuucagacaacugucugcacucacggcacacacacuuuguaucaugca

SEQ ID NO: 14992 - RNA, 62 nt, Human
cacuuaaaugacaagacaggauucugaaaacuccccguuuaacugauuauggaauaguucuu

SEQ ID NO: 14993 - RNA, 60 nt, Human
uccacucacuccaacaaagaacacuuagaaugauaaaaaaaaaaaaaaaaaaccugacaa

SEQ ID NO: 14994 - RNA, 62 nt, Human
ccugcccccuggcccccacucccccggcuccguguaaaauaaauguuccagcccaaccugug

SEQ ID NO: 14995 - RNA, 56 nt, Human
ucauccaaacugagcaguuucuguguauauauagaagguagaaaugaaaagugaga

SEQ ID NO: 14996 - RNA, 62 nt, Human
gaagauccacaaaauaagugaaaagagccuuaacugaugacauuccaccauugugauuuguu

SEQ ID NO: 14997 - RNA, 59 nt, Human
uggcaaugugaacugaagcugaugggcugagaacauggacugagcuuguggugugcuuu

SEQ ID NO: 14998 - RNA, 62 nt, Human
aaguuaaauaccgauaaaauggccuuaaguguauuccugacaguuaaauucagaaacgugcc

SEQ ID NO: 14999 - RNA, 59 nt, Human
uguugauuuucuuaaguugacgguugucaauauaucgaacuguucccaaguuagucaag

SEQ ID NO: 15000 - RNA, 62 nt, Human
guaaagggcagagaaggcccugagccaucaguuuacacucgaauuguugacuccccuuugug

SEQ ID NO: 15001 - RNA, 61 nt, Human
uccacagaguugcccagaacccuaaauuuauucauaagagaaaauauugauuaauuauugg

SEQ ID NO: 15002 - RNA, 62 nt, Human
uucuguggccucugugcccgaugaccugcguggcuucagacaaggccccagcguuacugggc

SEQ ID NO: 15003 - RNA, 56 nt, Human
cccagcaucaugaaucaacuugggaggagucaaccaaaugaacaaucuaccaaaaa

SEQ ID NO: 15004 - RNA, 62 nt, Human
guauuaauuugugaggcagggaguuauuuuagauuaugggaaauaauuuuuaaagguauugg

SEQ ID NO: 15005 - RNA, 62 nt, Human; identical to SEQ ID NO: 14133

SEQ ID NO: 15006 - RNA, 62 nt, Human
ccugaacugcugacgcgaaagaggcgcaguucccaauuaauacggaaaucgcugugggagaa

SEQ ID NO: 15007 - RNA, 62 nt, Human
aagggggccgacuccacgcuguccuuugggaugauacuuggaugcagcucuugggaccgugu

SEQ ID NO: 15008 - RNA, 62 nt, Human; identical to SEQ ID NO: 10120

SEQ ID NO: 15009 - RNA, 58 nt, Human
aacaccccagcggagaaaacagcauuauauacaucggaguaucauuuuaggauucaag

SEQ ID NO: 15010 - RNA, 62 nt, Human
uuugagcucauuugcaaacccgagucugccugggaacccgcacugugccuggguguauucuu

SEQ ID NO: 15011 - RNA, 61 nt, Human
ggcuuuuuacggcauaauuauggaauuuuuauuuacugguagagaggagacgagaggcuuu

SEQ ID NO: 15012 - RNA, 62 nt, Human; identical to SEQ ID NO: 14899

SEQ ID NO: 15013 - RNA, 60 nt, Human
uucuuguaaguuucaguuagcauuugcauguguaauauuaaaaugaaagagcuucuuacc

SEQ ID NO: 15014 - RNA, 62 nt, Human
cuuuacaaggccacgcgugcagcugucccauccagaccccgacuggccaagaccuccacguc

SEQ ID NO: 15015 - RNA, 56 nt, Human
ccugcccaggccacugugagggugggugcuggcugagccccuggggcagaaggagu

SEQ ID NO: 15016 - RNA, 62 nt, Human; identical to SEQ ID NO: 12936

SEQ ID NO: 15017 - RNA, 61 nt, Human
aaccuaaggaaugaaggguggguuugucaaaauaucaaguaaauuuuuguuucuaaaguac

SEQ ID NO: 15018 - RNA, 62 nt, Human; identical to SEQ ID NO: 11711

SEQ ID NO: 15019 - RNA, 60 nt, Human
auaacuuuuuuuuuaacuuaagaggauucaggguuaagcaccaacuaaauuaaaucaugc

SEQ ID NO: 15020 - RNA, 62 nt, Human
aguucaugagacgggaucugaguuagacaucaccaguggaaauugauuggaauagaaacuua

SEQ ID NO: 15021 - RNA, 61 nt, Human
aagccaucauaucuccugugaccugcacuuauacauccagauggccugaagcaacugaaga

SEQ ID NO: 15022 - RNA, 62 nt, Human
cuacuccaaacaaaacacaauaugccuaggggcacggaugaacguccagggagcccgggccc

SEQ ID NO: 15023 - RNA, 56 nt, Human
ggauuuucauuuucauguuuuauuuuguaaauauuaucugauguuuggagcuugag

SEQ ID NO: 15024 - RNA, 62 nt, Human
ggccucgccuggcugcagccugcgccaccgcccagagacccaagcugccuccccucuccuuc

SEQ ID NO: 15025 - RNA, 57 nt, Human
uggggccggguggggaagagugagaugggauaacauagccccugcuuggaggcccuu

SEQ ID NO: 15026 - RNA, 62 nt, Human; identical to SEQ ID NO: 12990

SEQ ID NO: 15027 - RNA, 55 nt, Human
cugccucauugcacuccccauaacauaaacggauaggcauuucaguguaaagagg

SEQ ID NO: 15028 - RNA, 62 nt, Human; identical to SEQ ID NO: 13408

SEQ ID NO: 15029 - RNA, 61 nt, Human
gacacuucacggaaggaagaucacauguccccagagaggcacccccaggcaagcucgaggg

SEQ ID NO: 15030 - RNA, 62 nt, Human; identical to SEQ ID NO: 14980

SEQ ID NO: 15031 - RNA, 62 nt, Human
cugcagcuaccuggguaaggacuugccagagaacuacaacgaggccaaaugugucaccuuca

SEQ ID NO: 15032 - RNA, 62 nt, Human; identical to SEQ ID NO: 12105

SEQ ID NO: 15033 - RNA, 62 nt, Human; identical to SEQ ID NO: 12106

SEQ ID NO: 15034 - RNA, 62 nt, Human
ccugccugacaguucgcucauuccaacuaaucaucaucuucaaguuuuccaccaagguaccu

SEQ ID NO: 15035 - RNA, 51 nt, Human
cccccuggggucaaaggugacagaaaaggcagaagcuggggcuuucuggag

SEQ ID NO: 15036 - RNA, 62 nt, Human; identical to SEQ ID NO: 12817

SEQ ID NO: 15037 - RNA, 60 nt, Human
gcacaucgaaauguauuauucgcuaguagcggcuacuuuaaaaugcuucuuucucagaau

SEQ ID NO: 15038 - RNA, 62 nt, Human
ccuuaaggggaccguggcccccaccagggacguccugcgccauccguucacgucucugcauc

SEQ ID NO: 15039 - RNA, 62 nt, Human
uugacuaggggaugggggacaguugacauuucugguccuacaggcccuuucuggccagggag

SEQ ID NO: 15040 - RNA, 62 nt, Human; identical to SEQ ID NO: 11491

SEQ ID NO: 15041 - RNA, 62 nt, Human; identical to SEQ ID NO: 11492

SEQ ID NO: 15042 - RNA, 62 nt, Human
auccaagagaaaacaccacacugugaugucaucgggaaaugaucucccaagucgcugccaga

SEQ ID NO: 15043 - RNA, 57 nt, Human
uaaucagagauaaccucuuuaaaaaaauuuuuaaagaacuauggcuaugaccaaagc

SEQ ID NO: 15044 - RNA, 62 nt, Human
cggugacgggagguguccuggcugcuccaggacaaaagacaaucgucucugugggugccggg

SEQ ID NO: 15045 - RNA, 60 nt, Human
cuacuucaauuaguuccccuacuacacuuugcuagugaaacugcccaggcaaagugcacc

SEQ ID NO: 15046 - RNA, 62 nt, Human
cggagacaccgcugcuuagcacccccagccagaacacccugagggucucggggcucuggaga

SEQ ID NO: 15047 - RNA, 62 nt, Human
acauggcacuucagcagagauucauagaugaugguaugcccaugcaucauuugcucuucaaa

SEQ ID NO: 15048 - RNA, 62 nt, Human; identical to SEQ ID NO: 11503

SEQ ID NO: 15049 - RNA, 62 nt, Human; identical to SEQ ID NO: 11698

SEQ ID NO: 15050 - RNA, 62 nt, Human
acgugacaguuugaaaccuucacaguuauccucuggggguaaaucaauucuucaacccuugg

SEQ ID NO: 15051 - RNA, 60 nt, Human
acagaggcaaggaggaugccggcaaggccuucgccagcuagaagcgggacugaggcugcc

SEQ ID NO: 15052 - RNA, 62 nt, Human
ugccagccucugugguccuugcccaaacccaucagcgcaauacuugaaccuucucccaggua

SEQ ID NO: 15053 - RNA, 62 nt, Human
uaguuuaccuaaugcccuuaccuaauuagauuaugauaaauagguuugucauuuugcaaguu

SEQ ID NO: 15054 - RNA, 62 nt, Human; identical to SEQ ID NO: 11715

SEQ ID NO: 15055 - RNA, 54 nt, Human
cuucccagccucuguguugagguugccggggguagggguggggccacacaaauc

SEQ ID NO: 15056 - RNA, 62 nt, Human
gucaccacaccguaacggggccauguaacugugcagcauggacagggaugcgacggggcagc

SEQ ID NO: 15057 - RNA, 61 nt, Human
cgcggacuccgcgcgaccccggcccucucccugcggccgcagggcuuccccgccuggcgcc

SEQ ID NO: 15058 - RNA, 62 nt, Human
cugcacgggacuuguggaugggccuggacucuccagaaacuacuugggcagagcaaaggaaa

SEQ ID NO: 15059 - RNA, 55 nt, Human
uguagacagugggguugugguugguugguauagaauggugggaauucaaauuuuu

SEQ ID NO: 15060 - RNA, 62 nt, Human
gcuguagaguaccuuuuuuuaaguaaaucuuacaguggaguauauuuuuuaaagcacaaaau

SEQ ID NO: 15061 - RNA, 62 nt, Human
ucauacaaugccugaucaugcugcuccugucacccuccacgauuccacagaccaggacauuc

SEQ ID NO: 15062 - RNA, 62 nt, Human
uuuuuguucuuuuagcagaucugucccuguggguggugucuaagaagucggacaccuugguu

SEQ ID NO: 15063 - RNA, 62 nt, Human
cugaauacauaucacguauuuuagacucgaagccucaaagcacuggauugugguccccugcc

SEQ ID NO: 15064 - RNA, 62 nt, Human
ccuccauauuuccuaagcagguuguauagggagccgguggcaggaggaaggcuguuuucaca

SEQ ID NO: 15065 - RNA, 61 nt, Human
uuuuucuaugucaaauguaacguuuauuuuuuuaaacaauaaaauugauuugccaaaaucc

SEQ ID NO: 15066 - RNA, 62 nt, Human; identical to SEQ ID NO: 13774

SEQ ID NO: 15067 - RNA, 57 nt, Human
cuucucagugagcauagguuggggacugugaucuugagaagccaugggccagcaaua

SEQ ID NO: 15068 - RNA, 62 nt, Human
aauuuguugcucagguguugcacaauuuuuaucuaacacugaggcuaucagcuccaacuaaa

SEQ ID NO: 15069 - RNA, 58 nt, Human
gagaggggaaccccacugguuuuuguggaaacaauggaaacuuacagaugccugccug

SEQ ID NO: 15070 - RNA, 62 nt, Human
agaauacgcuuuuccuaacaggcuacuccuuccuguagagcagaaauuguauuuugcacgaa

SEQ ID NO: 15071 - RNA, 60 nt, Human
auagggcaaauaauuuugucuuuguauaauagauuugauauuuaaagucacuggaaauag

SEQ ID NO: 15072 - RNA, 62 nt, Human; identical to SEQ ID NO: 13234

SEQ ID NO: 15073 - RNA, 62 nt, Human; identical to SEQ ID NO: 10470

SEQ ID NO: 15074 - RNA, 62 nt, Human; identical to SEQ ID NO: 13600

SEQ ID NO: 15075 - RNA, 60 nt, Human
aaggugaugcagaugugaccuaggacgauggaccgccggacucuuuucugcagcacacgc

SEQ ID NO: 15076 - RNA, 62 nt, Human
cacaaggccggggacacccaugccaagcagugggagcacgcaggacagacacagcagggguc

SEQ ID NO: 15077 - RNA, 62 nt, Human
aauaauccaggaagugucccggaaaagagagagaagacaucagagccuaaaggaaacagcug

SEQ ID NO: 15078 - RNA, 62 nt, Human; identical to SEQ ID NO: 9890

SEQ ID NO: 15079 - RNA, 60 nt, Human
uaauuugggauuucaaaacacaaaugaaaacucacacccacccacccccaagugcauguc

SEQ ID NO: 15080 - RNA, 62 nt, Human; identical to SEQ ID NO: 12015

SEQ ID NO: 15081 - RNA, 58 nt, Human; identical to SEQ ID NO: 14656

SEQ ID NO: 15082 - RNA, 62 nt, Human; identical to SEQ ID NO: 12015

SEQ ID NO: 15083 - RNA, 58 nt, Human; identical to SEQ ID NO: 14656

SEQ ID NO: 15084 - RNA, 62 nt, Human; identical to SEQ ID NO: 10919

SEQ ID NO: 15085 - RNA, 59 nt, Human
gccguccacagggucggcccucagcucagcccgccaggagucagggaggagacucgcug

SEQ ID NO: 15086 - RNA, 62 nt, Human; identical to SEQ ID NO: 10919

SEQ ID NO: 15087 - RNA, 59 nt, Human; identical to SEQ ID NO: 15085

SEQ ID NO: 15088 - RNA, 62 nt, Human; identical to SEQ ID NO: 13698

SEQ ID NO: 15089 - RNA, 61 nt, Human
aaacuuuguuguuuaaauuuguuaacuuuuuauauuaaugacuauugaaagugguaauaaa

SEQ ID NO: 15090 - RNA, 51 nt, Human; identical to SEQ ID NO: 12366

SEQ ID NO: 15091 - RNA, 62 nt, Human; identical to SEQ ID NO: 10389

SEQ ID NO: 15092 - RNA, 62 nt, Human
uacaagaccugauuuugguucuaacacaguggucuuugacuaucaacauugauguuuuuaga

SEQ ID NO: 15093 - RNA, 62 nt, Human; identical to SEQ ID NO: 10542

SEQ ID NO: 15094 - RNA, 62 nt, Human
aaaaguuaaauaccgauaaaauggccuuaaguguauuccugacaguuaaauucagaaacgug

SEQ ID NO: 15095 - RNA, 54 nt, Human
gcuguugggauucugauuaaaagaggggaaacgaucauccuggacaggaaguga

SEQ ID NO: 15096 - RNA, 62 nt, Human
gaagugugccugcccucgugugacauggaauuggugucaggaccgccacguggccuucagag

SEQ ID NO: 15097 - RNA, 58 nt, Human
ccuaccaccagggccagcuaauuuuuguauguuuaguagaaacgggguuucaccaugu

SEQ ID NO: 15098 - RNA, 62 nt, Human
auacugaauuuagauaucuuuauuccauuuauuaugguacaaauaacugauguuuuaaccag

SEQ ID NO: 15099 - RNA, 62 nt, Human
ucugaagagagggacagaccgucagaaacuggagaguuucuauuaaaggucauuuaaaccac

SEQ ID NO: 15100 - RNA, 62 nt, Human; identical to SEQ ID NO: 9522

SEQ ID NO: 15101 - RNA, 51 nt, Human; identical to SEQ ID NO: 11131

SEQ ID NO: 15102 - RNA, 62 nt, Human
cggccaagcuccugcccagauguugacccucacccagcgugagcugucacauaguaggagcu

SEQ ID NO: 15103 - RNA, 62 nt, Human
uuuuuaauguuucagacaggcacuuggacuuacagcguucgaaacaaucauaccaaaucuca

SEQ ID NO: 15104 - RNA, 62 nt, Human
auacauccagauggccugaagcaacugaagauccacaaaauaagugaaaagagccuuaacug

SEQ ID NO: 15105 - RNA, 61 nt, Human
ccaaaucccuguuugccaucguuuuuacuguaccgauguuaacuguaguaauccuuagcca

SEQ ID NO: 15106 - RNA, 62 nt, Human
ggagaccuugggccuuuggccuguggggcacuggggaugguaaccucacugccccgucacuc

SEQ ID NO: 15107 - RNA, 60 nt, Human
auguggcaaaccaaccccaggcccacccagagcgagcaaacgcugagaccugaaaggaca

SEQ ID NO: 15108 - RNA, 62 nt, Human
gggcccaagcuaagccaucauaucuccugugaccugcacuuauacauccagauggccugaag

SEQ ID NO: 15109 - RNA, 61 nt, Human; identical to SEQ ID NO: 14450

SEQ ID NO: 15110 - RNA, 62 nt, Human
ucuaguuuugaauaagucugggugaccgcaccuaaaaugguaagcaguacccuccggcuuuu

SEQ ID NO: 15111 - RNA, 61 nt, Human
uaagacaaguguucuauuuauuucuuguauuguuuggaagaaaaaaugaugauagaguccc

SEQ ID NO: 15112 - RNA, 62 nt, Human
uugcaaacugaucucucccccgugaaggaguugagcacauuagcaacaauguacauuaauuu

SEQ ID NO: 15113 - RNA, 59 nt, Human
gcgcacucauauaugcuaagccuucuguucucuaauagaagccuuucuuuuccauuguu

SEQ ID NO: 15114 - RNA, 62 nt, Human
uccaacuagaaauggucaaggaauucauuuggcuccuugauacaucaguccucaauauuacu

SEQ ID NO: 15115 - RNA, 62 nt, Human
caucaucuucaaguuuuccaccaagguaccuacauucuaccacgccuggguccaaaaccacg

SEQ ID NO: 15116 - RNA, 62 nt, Human; identical to SEQ ID NO: 9953

SEQ ID NO: 15117 - RNA, 60 nt, Human
acccugugggugggugggugugacagcaggagcauugccaucuuggacaaacauggccau

SEQ ID NO: 15118 - RNA, 62 nt, Human; identical to SEQ ID NO: 14013

SEQ ID NO: 15119 - RNA, 62 nt, Human
gggcaggcggggucuuuguucucggcucccacagcagagccaggugagggggggccugccag

SEQ ID NO: 15120 - RNA, 62 nt, Human
agaccaucccugaagacgagcaucccccuccucucccuguuagaaauguuagugccccgcac

SEQ ID NO: 15121 - RNA, 62 nt, Human
ucugcccuaucaagcccagugacucagaucgcauugaaccuaaagcugugaaggcuuugaag

SEQ ID NO: 15122 - RNA, 55 nt, Human
uugucauugccuccgugugagccacugagugguuaucaccucagugaaucuuccc

SEQ ID NO: 15123 - RNA, 61 nt, Human
ugauugacucaauggcuuguugaaucucagcaguuccgccaucuugaagaaugauugauug

SEQ ID NO: 15124 - RNA, 55 nt, Human; identical to SEQ ID NO: 15122

SEQ ID NO: 15125 - RNA, 61 nt, Human; identical to SEQ ID NO: 15123

SEQ ID NO: 15126 - RNA, 62 nt, Human
aauaggaucugucacgggguucauaucagaugaagcgccguauccacugcuucacagagcaa

SEQ ID NO: 15127 - RNA, 60 nt, Human
aacuucugucauuuucaucauagcaagucuaugcggacaaaagccuccaaacuuuccaac

SEQ ID NO: 15128 - RNA, 62 nt, Human
cucagcucuccccagugccuuuuggccacugcagcuaccguagaauggcauuuuauauguac

SEQ ID NO: 15129 - RNA, 57 nt, Human
gcacugaaaggaaugaagcaccagcaggagguggacagagucucucauggaugccgg

SEQ ID NO: 15130 - RNA, 62 nt, Human
cuuacuuaauacaaauaaauguuuuuuaaagcuuuuguaguauguuuuuaugaguuaacauc

SEQ ID NO: 15131 - RNA, 62 nt, Human; identical to SEQ ID NO: 11198

SEQ ID NO: 15132 - RNA, 62 nt, Human; identical to SEQ ID NO: 9541

SEQ ID NO: 15133 - RNA, 62 nt, Human; identical to SEQ ID NO: 12185

SEQ ID NO: 15134 - RNA, 62 nt, Human
uuguggaaauuugcagaggggcaggugugugguaaacggguaaugcaugggaaauaaugaga

SEQ ID NO: 15135 - RNA, 50 nt, Human
ugguaggaggccaccccugaccacggcucaguacuugccaccugcuggcc

SEQ ID NO: 15136 - RNA, 62 nt, Human
guuugccacggauccagaggccaccugcccugucuucucguaccccuuucacucuugaggcc

SEQ ID NO: 15137 - RNA, 60 nt, Human
uggccagaggugaccucaguguucccuccaggggcauccaggccccucugaccuggggag

SEQ ID NO: 15138 - RNA, 62 nt, Human
gauacaggagcugggcuggcuauggcuuuaccacaacaaguagguuugcuuaagaaauuacu

SEQ ID NO: 15139 - RNA, 60 nt, Human
caggaacagccacacacgguucuccaggccgccgucagcagcucaaggugggguaugagu

SEQ ID NO: 15140 - RNA, 62 nt, Human
cuggccucaaaugaugcaugugaggucaggauucauugaguagaaugcccccaccaagugcc

SEQ ID NO: 15141 - RNA, 62 nt, Human
gcugugucagugaagauguacgacuaccuguugggaaggacaaagggaugaggcuccagaga

SEQ ID NO: 15142 - RNA, 62 nt, Human
guuugcagguaagaaaauaauagaugacucaccacaccucuacggcuggggagaucaggccc

SEQ ID NO: 15143 - RNA, 60 nt, Human
uaacuggggaaagaaguugugaucuguugccuaaacuaaagcuuaaaaguuuaguaaaaa

SEQ ID NO: 15144 - RNA, 62 nt, Human; identical to SEQ ID NO: 9764

SEQ ID NO: 15145 - RNA, 61 nt, Human
agccccucccacugccugacaccugggacaggcugggcagaggggagagagggcaggacag

SEQ ID NO: 15146 - RNA, 62 nt, Human
aagaucgcuauuucagucucucagauaaagaugccaauucuaaugguguagaacguuccucu

SEQ ID NO: 15147 - RNA, 60 nt, Human
uuuguuuuuaaaauaaugauuguaaaauguuuuacaaguaauguaaaagcuaguaucauu

SEQ ID NO: 15148 - RNA, 62 nt, Human
accaucuuccuguccugccugacaguucgcucauuccaacuaaucaucaucuucaaguuuuc

SEQ ID NO: 15149 - RNA, 62 nt, Human; identical to SEQ ID NO: 10610

SEQ ID NO: 15150 - RNA, 62 nt, Human
ucugccucugucgauuuuaggguauggauauuaggagccauaacuuguaaucuuguucucug

SEQ ID NO: 15151 - RNA, 61 nt, Human
aacgagggucccgauccccggggcggcaggaagggggccgacuccacgcuguccuuuggga

SEQ ID NO: 15152 - RNA, 62 nt, Human
agugcgugacugugacaggcccaugggcccggacugcccauaggggucacuguaccauggca

SEQ ID NO: 15153 - RNA, 54 nt, Human
uugaaagggauuauauuaauugcuaaauauuuuauucacaaaggucaauaacau

SEQ ID NO: 15154 - RNA, 62 nt, Human
ccccacccacaucucaucuugaaugguaauccuggguguuuagggagagaccuggugggaag

SEQ ID NO: 15155 - RNA, 62 nt, Human
acccagugugauggggggagucucuggggcccugaguucagagcccgucccucagcuccugu

SEQ ID NO: 15156 - RNA, 62 nt, Human
guacuaggaguccuaagaaauguucuguucuuguacauuauacugauuaagucaggauuaau

SEQ ID NO: 15157 - RNA, 59 nt, Human
uuuuucugucuuuggagaguauuuuagaaacuccaaugaaagacacuguuucuccuguu

SEQ ID NO: 15158 - RNA, 62 nt, Human; identical to SEQ ID NO: 10079

SEQ ID NO: 15159 - RNA, 60 nt, Human
uccucuaccagugacguucgccaucauaccgccagcgcgacagccaccuggugccaacuc

SEQ ID NO: 15160 - RNA, 62 nt, Human
cacauaauugauaaugguaccaccuucuauaauaauaauauaaaauaaaaacaucugauguc

SEQ ID NO: 15161 - RNA, 58 nt, Human
guuuggaagaaaaaaugaugauagagucccaaaaagaagagaaaaaaaaugcccaagu

SEQ ID NO: 15162 - RNA, 62 nt, Human
caggggcagggaccccagggggauugacucugcaguuugggagccacaaaaagcguagcggu

SEQ ID NO: 15163 - RNA, 62 nt, Human; identical to SEQ ID NO: 13836

SEQ ID NO: 15164 - RNA, 62 nt, Human; identical to SEQ ID NO: 14836

SEQ ID NO: 15165 - RNA, 60 nt, Human
acauagcugcuccuggucaguggaggucagccggguaucaaaagccaugaaacugugucu

SEQ ID NO: 15166 - RNA, 62 nt, Human; identical to SEQ ID NO: 12775

SEQ ID NO: 15167 - RNA, 56 nt, Human
ggguuacccucugguauauguucuuuugcuaaaugaaggcuuggaguuggagggaa

SEQ ID NO: 15168 - RNA, 62 nt, Human
acuucuuuuacaggcuugaaaaaucucaaauaaacgcuaagaaaagggaguaggaagaacaa

SEQ ID NO: 15169 - RNA, 60 nt, Human
uugacugcagagucuauuuaagcaugugguuuuaaaaauagacaguauuuuuuaaaaauc

SEQ ID NO: 15170 - RNA, 62 nt, Human
uuaacaccauccacucacuccaacaaagaacacuuagaaugauaaaaaaaaaaaaaaaaaac

SEQ ID NO: 15171 - RNA, 62 nt, Human; identical to SEQ ID NO: 13098

SEQ ID NO: 15172 - RNA, 62 nt, Human
cccuucauuuugggacugaggcugcagcauuggaacaaaagagcauuauuucaauuuuucuu

SEQ ID NO: 15173 - RNA, 62 nt, Human
auugguagguuuucauaagcauuguuucuuuaaggcauggaaagggaagaaugcucaagcaa

SEQ ID NO: 15174 - RNA, 62 nt, Human
gccaggauccugccuaggagaaaggccacgaauggcagcggaaauuacaucaaaccagaaac

SEQ ID NO: 15175 - RNA, 60 nt, Human
aaucuaguuuaauacugcauuauuuauuuuccuaaggcuaaagaggagcaguccuaugcu

SEQ ID NO: 15176 - RNA, 62 nt, Human
gguuccuggagcuagugguuaccugaacagguauggcgaugagcuacaacaucaccugaguc

SEQ ID NO: 15177 - RNA, 60 nt, Human
gaaucaagugccuucugcaaaucauguuggaaaaguccaaaccuggagaugucccugugc

SEQ ID NO: 15178 - RNA, 62 nt, Human
aauuguuuuuuaaaaguaauuuugcauugcuuugaaauuugagcucauuugcaaacccgagu

SEQ ID NO: 15179 - RNA, 59 nt, Human
auacauuggguguauauuuauucugaacgggagaaguuauauuguuaaaaguguaaaag

SEQ ID NO: 15180 - RNA, 62 nt, Human
ggcuugcucgcggccccgaguccaggggaccagggcgucggaaucacaguuuaaccggcggg

SEQ ID NO: 15181 - RNA, 62 nt, Human
uaaccguauugacugcagagucuauuuaagcaugugguuuuaaaaauagacaguauuuuuua

SEQ ID NO: 15182 - RNA, 62 nt, Human
ggagaugcagauauccuaucaccagaaugaaagcuauugggacaacaggaucggggaugacc

SEQ ID NO: 15183 - RNA, 62 nt, Human
agauggguucuucugguugauacagacuaugcauugcguuuagcagaugggguaaaacuggc

SEQ ID NO: 15184 - RNA, 62 nt, Human
ugccccugggauucucaggccaaccugccaacagcaagcggauuuucuugcaagaucaggga

SEQ ID NO: 15185 - RNA, 60 nt, Human
gauuuuuaauuacaauaaugaguucacuacagacgauuaacacaccacacuggcgaacca

SEQ ID NO: 15186 - RNA, 62 nt, Human
caccucgggguggcagagggacggcccccacggcccagcagacaugcgagcuuccagagugc

SEQ ID NO: 15187 - RNA, 62 nt, Human
gugccuuuuggaggauuucuuggaagagcauuuauggagauacuuaagggagguagcaaaga

SEQ ID NO: 15188 - RNA, 62 nt, Human; identical to SEQ ID NO: 10341

SEQ ID NO: 15189 - RNA, 56 nt, Human
gauuucauuauaaaauuaauagcuaaucuuauucuaucuccugaagauuuaauugc

SEQ ID NO: 15190 - RNA, 62 nt, Human
gucugcacagcgagaaguacugugaugacuuugagccguugacauguaugucuucagaugcc

SEQ ID NO: 15191 - RNA, 62 nt, Human
ccauguaguuuuggaacccacugcaaaauuuucuacuggccaaguucaagugaguaagccgc

SEQ ID NO: 15192 - RNA, 62 nt, Human
accaugaaguuaucauugaauguuaagauuuuuucuucuugauuuuuuaauacacguaaucu

SEQ ID NO: 15193 - RNA, 57 nt, Human
cccaggauaugaauuuuugcaucuucccauugucgaauuagucuccagccucuaaau

SEQ ID NO: 15194 - RNA, 62 nt, Human; identical to SEQ ID NO: 9806

SEQ ID NO: 15195 - RNA, 61 nt, Human
cgaucuggguguccugacccucagcuggcccugcccagccacccuggacgugaccguaucc

SEQ ID NO: 15196 - RNA, 62 nt, Human
guacaugaacaguggugcggugccagucuguguccguugugaucacaggccuugcuagaccc

SEQ ID NO: 15197 - RNA, 62 nt, Human; identical to SEQ ID NO: 12941

SEQ ID NO: 15198 - RNA, 62 nt, Human
gaaaucucagugcuguuuggagcuccauuucucauuugaugacuugcucugcguggggaggu

SEQ ID NO: 15199 - RNA, 62 nt, Human; identical to SEQ ID NO: 9446

SEQ ID NO: 15200 - RNA, 62 nt, Human; identical to SEQ ID NO: 12589

SEQ ID NO: 15201 - RNA, 61 nt, Human
gguucgcgccauucaccugccucagccucuggaguagcugagacuacaggcgcccaccacc

SEQ ID NO: 15202 - RNA, 62 nt, Human; identical to SEQ ID NO: 12217

SEQ ID NO: 15203 - RNA, 60 nt, Human
aguaaauuggcaccgugucacacuguuuccugggauucaaguaugcaaccagaacacagg

SEQ ID NO: 15204 - RNA, 62 nt, Human
uaugggaucugauaaggaucuaggagaagggucucaugcggacccucacaugggcagaaaaa

SEQ ID NO: 15205 - RNA, 62 nt, Human
gacacuuggaaacuaaaaccuaggucuuagguacauccuaaagggagcacagaacccaucau

SEQ ID NO: 15206 - RNA, 62 nt, Human
uugugugauauuuuugcuugauagagaaucaaauuugaaacaauuaaccagccaguagauug

SEQ ID NO: 15207 - RNA, 62 nt, Human
caccagugugugaagacucuugagucugguucucauaucagagucaucauuuuucuuccugu

SEQ ID NO: 15208 - RNA, 62 nt, Human
ccggcaccuuuuguuugucccauugguggcagaugugagcgacaucaggcgcuuccucagug

SEQ ID NO: 15209 - RNA, 51 nt, Human
cguuuuaagucauauauuuucgucccccugaaaaugauggcaagcccaguu

SEQ ID NO: 15210 - RNA, 62 nt, Human
gggcagcugcaaucagcuucuuuauaugcaaauuaggcacgacccaucugugguuccugguu

SEQ ID NO: 15211 - RNA, 61 nt, Human
uccaggccguggaggggguccuagcuccgcugcauucugcaucccaagugggcacguggag

SEQ ID NO: 15212 - RNA, 62 nt, Human; identical to SEQ ID NO: 12478

SEQ ID NO: 15213 - RNA, 61 nt, Human
agcccaggggcaaugguuuggugugagcuuacagcgacguaaagagggcacagcagggcca

SEQ ID NO: 15214 - RNA, 62 nt, Human
acaauguaggaaaagaccucagggaaccucucccuggaaagacgggcagggcugguuagccc

SEQ ID NO: 15215 - RNA, 60 nt, Human
ugacuaaacugcaaaaaaaaaaaaagagcuacuguauuuagacuuaggaaaaaaggcaga

SEQ ID NO: 15216 - RNA, 62 nt, Human
caguuggcaacagcgcagagcugaccccucgcagcgaggagaaucgcugccccgccccggac

SEQ ID NO: 15217 - RNA, 61 nt, Human
ucccgaggcccagggccaaggcacucccaccgccuaccuuagcacagggucucugcaggac

SEQ ID NO: 15218 - RNA, 62 nt, Human
acggucccacccaagccugucaccucugcucauccuccaagaccacccagcuuucucccagc

SEQ ID NO: 15219 - RNA, 62 nt, Human
cuuguacagcaaauccugacucgugucuuuuuacccccaagauaucugucuucaguagcgac

SEQ ID NO: 15220 - RNA, 62 nt, Human
auauucugccauaggaauacugucuacaugcuuucucauucaagaauucgucaucacgcauc

SEQ ID NO: 15221 - RNA, 60 nt, Human
guguauacuguucuucagcuugucuucucuguguaacauauuuuugagauugucccaugu

SEQ ID NO: 15222 - RNA, 62 nt, Human
augcaaguuaaaauguuucagugaacaaguuucagcgguucaacuuuauaauaauuauaaau

SEQ ID NO: 15223 - RNA, 58 nt, Human
cccuagcagcaaaggcccuugagcagcgcggugugaaacugggauaaaaacggggcuu

SEQ ID NO: 15224 - RNA, 62 nt, Human
ccaagugaagagugugguuugcauccaagagaaaacaccacacugugaugucaucgggaaau

SEQ ID NO: 15225 - RNA, 60 nt, Human
auauccuaucaccagaaugaaagcuauugggacaacaggaucggggaugaccgacggccc

SEQ ID NO: 15226 - RNA, 62 nt, Human; identical to SEQ ID NO: 9434

SEQ ID NO: 15227 - RNA, 61 nt, Human
cuccaugcacaaguucauucccuccaugcugucgucaucgacauauacagguguguacgua

SEQ ID NO: 15228 - RNA, 62 nt, Human
cccucacucgccuucgagagauaaagaaagcguuaccucucauuucucuuugugauucuuga

SEQ ID NO: 15229 - RNA, 61 nt, Human
augucagacuggcuggcugcagugacgugcaccuguacucaggaggcugaggggaggauca

SEQ ID NO: 15230 - RNA, 62 nt, Human; identical to SEQ ID NO: 12335

SEQ ID NO: 15231 - RNA, 62 nt, Human; identical to SEQ ID NO: 11015

SEQ ID NO: 15232 - RNA, 62 nt, Human
uauuauagaaugcauguauuuucuuuuaucuuuggaacaucagcaccaguauauugcuggca

SEQ ID NO: 15233 - RNA, 60 nt, Human
gcuguuuugaagccaagugaagagugugguuugcauccaagagaaaacaccacacuguga

SEQ ID NO: 15234 - RNA, 62 nt, Human
cccgcggagcugacuucagcagcccacagcuguggggcuucagcagccacaccagcccagcc

SEQ ID NO: 15235 - RNA, 62 nt, Human; identical to SEQ ID NO: 10983

SEQ ID NO: 15236 - RNA, 62 nt, Human
cuguauauuuuguaaauaaauauauugcuacuuugagguucaugauucaagguucaggcgau

SEQ ID NO: 15237 - RNA, 60 nt, Human
ggaaucggaagcgaccgcgggcuuuuuugcccuucucuuaguugagcacagaacccucag

SEQ ID NO: 15238 - RNA, 62 nt, Human
aaaaaccuggggaggaauuauuuuuuccaaaacagaugauaauuucugauucaaagagaaag

SEQ ID NO: 15239 - RNA, 62 nt, Human
ucgucuuagacuuuguggcucuaaaguaccugucuguugagauuucaagucucuugucacca

SEQ ID NO: 15240 - RNA, 62 nt, Human
gagucgagccucacagaagccagcgcgggucucugcucagcaccccagccggggcucuggac

SEQ ID NO: 15241 - RNA, 62 nt, Human
uuucacccuggggugagcaucaguccuggcucugcugguccagaucuugcgcucagcacacu

SEQ ID NO: 15242 - RNA, 62 nt, Human
uuggugcaagucuggcagcuagguagaaaaggcacucuagcaggugugguaggagcacgccc

SEQ ID NO: 15243 - RNA, 57 nt, Human
caguucuucagcucuaggacuuguagcuuuaagcaaacgguguggcauggguugagu

SEQ ID NO: 15244 - RNA, 62 nt, Human; identical to SEQ ID NO: 9974

SEQ ID NO: 15245 - RNA, 61 nt, Human
cugccugcagaagagccagcuggcgugucgggaaggauccaggaucugcaaacacaacugc

SEQ ID NO: 15246 - RNA, 62 nt, Human; identical to SEQ ID NO: 10279

SEQ ID NO: 15247 - RNA, 61 nt, Human
uaaagcacuagaauuuuuggucaaaagucaaaauaguauuagaauauugaaauuauugaua

SEQ ID NO: 15248 - RNA, 62 nt, Human
cugugcugcugucaccaggcaccuuuguuuuucaagacaacauacuuuuuuuuucuuuucuc

SEQ ID NO: 15249 - RNA, 60 nt, Human
aaaaaugggggcgauguccccacauggagggaacacccgacuuagcaaaugggaccgguc

SEQ ID NO: 15250 - RNA, 62 nt, Human
aagaaggaccucauuucuuauagccucuccugugauucaacacaacccauggagaugucccc

SEQ ID NO: 15251 - RNA, 62 nt, Human
agaugagauuucaguaugauuuuaucagcuauuucuuauauaucauaaucuggcaauuucug

SEQ ID NO: 15252 - RNA, 62 nt, Human
caugguauauuacuauuuccacauaaugaggagccaaagaaaucugauguuuuuaacaauua

SEQ ID NO: 15253 - RNA, 62 nt, Human; identical to SEQ ID NO: 12151

SEQ ID NO: 15254 - RNA, 62 nt, Human
uugguugaacaagggaaucacaagaaaacgaaaaugcaaaaacugaacuucgggggucguuc

SEQ ID NO: 15255 - RNA, 57 nt, Human
ucuucauuccgugguacgauuauuuuuuuuaacuaaaggaagauaaaauucuauauu

SEQ ID NO: 15256 - RNA, 62 nt, Human
ggccguuaggaauccauucucacuguguucgcucuaaacaaaacagugguagguuaaugugu

SEQ ID NO: 15257 - RNA, 55 nt, Human
auauauagaagguagaaaugaaaagugagaaaauauuugaaagggauuauauuaa

SEQ ID NO: 15258 - RNA, 62 nt, Human; identical to SEQ ID NO: 13662

SEQ ID NO: 15259 - RNA, 62 nt, Human; identical to SEQ ID NO: 11234

SEQ ID NO: 15260 - RNA, 62 nt, Human
ggaaucccagcacuuugggaagccgaggugggcagaucauaaggucgggagauuaagaccau

SEQ ID NO: 15261 - RNA, 60 nt, Human
uuuccuauccuuucuuccccccucacugugaaaaauaacaguccaccccaagucauacac

SEQ ID NO: 15262 - RNA, 62 nt, Human; identical to SEQ ID NO: 9488

SEQ ID NO: 15263 - RNA, 60 nt, Human
gugugcucaaaagagagagaucacucaaaugauuuuuauaaugaaaugacaagaauaacc

SEQ ID NO: 15264 - RNA, 62 nt, Human
ggaaggaagaucacauguccccagagaggcacccccaggcaagcucgagggggccacaccgu

SEQ ID NO: 15265 - RNA, 62 nt, Human
gucaccgcgccuggccaauguuguuguuguuuuuaagacagaauuucacucuuuguugccca

SEQ ID NO: 15266 - RNA, 62 nt, Human
cacuaauucuagaugucuaauucaggauacugucuauagaaaggcauucuuaaaaguuaaag

SEQ ID NO: 15267 - RNA, 59 nt, Human
aaacucaugguaaguauauuguaaaauacauauguacuaagaauuuucaaaauugguuu

SEQ ID NO: 15268 - RNA, 62 nt, Human
aguggccgguccccgcugugccaggugggcaggcaggagcaaggccugcgagggaggaacgg

SEQ ID NO: 15269 - RNA, 60 nt, Human
acugccgccuaccccgcccgccacgccgccgucgaugccagcgcuguccccacggguacc

SEQ ID NO: 15270 - RNA, 62 nt, Human
gcuggcugaggugcaugggccccacacaggacagcuggagaaugggccguccacuuggccuc

SEQ ID NO: 15271 - RNA, 60 nt, Human
accacccacaagcucaacugugacccaagcagaaucuacaaaccccagacaagguugaag

SEQ ID NO: 15272 - RNA, 62 nt, Human
acagcccuagcagcaaaggcccuugagcagcgcggugugaaacugggauaaaaacggggcuu

SEQ ID NO: 15273 - RNA, 62 nt, Human
ccacauaacaacaucuugguaaacaacagacugcauauaugaugguggucauccaguaagcu

SEQ ID NO: 15274 - RNA, 62 nt, Human; identical to SEQ ID NO: 15272

SEQ ID NO: 15275 - RNA, 62 nt, Human; identical to SEQ ID NO: 15273

SEQ ID NO: 15276 - RNA, 62 nt, Human
gggggcgccugccagggccagacccagguggggcagccugaacccugcuucccccuguggcc

SEQ ID NO: 15277 - RNA, 60 nt, Human
accuguggucccaccuauucgggaggcugaagugcgaggaucacuugagcccaggagguu

SEQ ID NO: 15278 - RNA, 62 nt, Human
agguuugucauuuugcaaguuacauaaacauuuaucaaugaagucauccuuuagacuuguaa

SEQ ID NO: 15279 - RNA, 60 nt, Human
cccccacgugugcacgagugaaggccaauucucgcagaaauucgccaaucacagugcagc

SEQ ID NO: 15280 - RNA, 62 nt, Human
acccagcuuucucccagccacagccaagauucccaaagucaaggcccaaagauuuccaaggu

SEQ ID NO: 15281 - RNA, 59 nt, Human
uuuaaaaauagacaguauuuuuuaaaaaucaaaaaaugacuugcaaauuguuuuuuaaa

SEQ ID NO: 15282 - RNA, 62 nt, Human
ccuguaaaaacaaaacaaacaaaacaaaacaaaaaagacaaaaccuaaaacugagcuaucua

SEQ ID NO: 15283 - RNA, 62 nt, Human
gcgcaguucccaauuaauacggaaaucgcugugggagaagaaugaaauaagacgugaagugu

SEQ ID NO: 15284 - RNA, 62 nt, Human
uuggcauuaauuauauaucacugccacccucugaacuuugaaaacugccaucuucagacuug

SEQ ID NO: 15285 - RNA, 62 nt, Human
ccccagcuauuuucugaccaaaauguguuucauaacaaaccaucuggugccuuuccacacag

SEQ ID NO: 15286 - RNA, 62 nt, Human
augaaggaacuaagucauugugaacugucucuugagaucuaaaaacaagaugacuuuuccug

SEQ ID NO: 15287 - RNA, 62 nt, Human
uucuacagaccgguuuagagcuggugcccuaugagaauauuagggagcuuuuauuuuaaauu

SEQ ID NO: 15288 - RNA, 62 nt, Human; identical to SEQ ID NO: 13638

SEQ ID NO: 15289 - RNA, 62 nt, Human
cagucccccagauaccuauuauuuuacacaauuugaccuauaggaggacacugaguaauuua

SEQ ID NO: 15290 - RNA, 62 nt, Human
ggcacccacugguucccaggcuggaaccagggucucucuuuaccuccuaccccaugguggca

SEQ ID NO: 15291 - RNA, 62 nt, Human; identical to SEQ ID NO: 9549

SEQ ID NO: 15292 - RNA, 62 nt, Human
guaaagccagugccagcaauaacaguuuaucaugcucauuaauuugggauuucaaaacacaa

SEQ ID NO: 15293 - RNA, 61 nt, Human
agggaagaaggggagauggaguggugagggcgagucaaauaaaaggauuugagugucucgu

SEQ ID NO: 15294 - RNA, 62 nt, Human; identical to SEQ ID NO: 12163

SEQ ID NO: 15295 - RNA, 62 nt, Human
aucucagcgaggccaaggagaguggaucaccugaggucgggaguuccagaccagccuggcca

SEQ ID NO: 15296 - RNA, 62 nt, Human
ucauuuuuguucaguggaauagagacagcaacaugguguuaaccucucaauuaaaauacaau

SEQ ID NO: 15297 - RNA, 62 nt, Human; identical to SEQ ID NO: 10629

SEQ ID NO: 15298 - RNA, 62 nt, Human
aaaaaaacaaauugggaaaugaaaaaaaaaugggaagauuaaaaagcacagggggaagaaga

SEQ ID NO: 15299 - RNA, 54 nt, Human
aguuuaagguaauuucuaaguauacuaccuauaaguaacugauaagaauuaggc

SEQ ID NO: 15300 - RNA, 62 nt, Human
cgcuucuaucugugcacuuagcugggaacuuacccacuguaaucaccuaaauaaaguguuua

SEQ ID NO: 15301 - RNA, 61 nt, Human
gcaagagcaacugauggcugccacuuccaggccccgagagacaggccucacguaacuuuac

SEQ ID NO: 15302 - RNA, 62 nt, Human; identical to SEQ ID NO: 14041

SEQ ID NO: 15303 - RNA, 53 nt, Human
ugggggcagggcagacgccgugugucuguuucacgguagguaccucucuuugg

SEQ ID NO: 15304 - RNA, 62 nt, Human
cucugugugacccacgaacgggaagggagagcacuggaguaaugacacuucugcugcugcuu

SEQ ID NO: 15305 - RNA, 56 nt, Human
guuugaacccgggaagcggagguugcagggagccgagaucacgccacugcacucca

SEQ ID NO: 15306 - RNA, 62 nt, Human
uguccgaaagaacuuaacguuuuaaaggugauugucaaguaacugugugggguucuaaugcc

SEQ ID NO: 15307 - RNA, 60 nt, Human
aggcagggccaacagcagcccccgggccagguguccuggagcagcagcagcugcccgugc

SEQ ID NO: 15308 - RNA, 62 nt, Human
ugcaguaaauaacauuuuuucuuccagucucaacauacauaauuaaucaagugagaaaaugu

SEQ ID NO: 15309 - RNA, 60 nt, Human
gcccagggugggccagaccagcagcccaggaagcagcacacgcggccguggggaggcagg

SEQ ID NO: 15310 - RNA, 62 nt, Human
cacaauuagaaucguaaagugaauucuaucuauuuaauuggauauuggacucugcucauaua

SEQ ID NO: 15311 - RNA, 62 nt, Human
aauuuuuauuaaaaggaaaauucuguagaugcacuuauugaauaugugauuaggaucuacgu

SEQ ID NO: 15312 - RNA, 62 nt, Human
ugauuauuuucuaaugcuuuguagcaaagcauaucaauugaaaagggaauaucagcaccuuc

SEQ ID NO: 15313 - RNA, 62 nt, Human; identical to SEQ ID NO: 10888

SEQ ID NO: 15314 - RNA, 62 nt, Human
guuccgggccguuccccucccgccgccguucggcgcgcacgagauggguuuauggguugggg

SEQ ID NO: 15315 - RNA, 62 nt, Human
agugagcugagaucgugccauuacacuccagccugggcgaaagggugagacuccaucucaaa

SEQ ID NO: 15316 - RNA, 62 nt, Human
uaaaggggcugaagagccugaacugcaccuaacgggaaagaaccgacauggcugccuuuugu

SEQ ID NO: 15317 - RNA, 61 nt, Human
gucugcauucuuaacugguaccaccagugauucugaugcgaugcuucaaucccgagauuuc

SEQ ID NO: 15318 - RNA, 62 nt, Human; identical to SEQ ID NO: 11768

SEQ ID NO: 15319 - RNA, 61 nt, Human
uaaagaagggagagcugacucuccauugcuuuucuaguggaaaccagccaguuugacggca

SEQ ID NO: 15320 - RNA, 62 nt, Human
agagagaucacucaaaugauuuuuauaaugaaaugacaagaauaacccuuuugguaaccgua

SEQ ID NO: 15321 - RNA, 62 nt, Human
acagaauuuucgucuuuaccuaugugaagcgaggugacgugauacgucacuggcgccgucuu

SEQ ID NO: 15322 - RNA, 62 nt, Human; identical to SEQ ID NO: 10113

SEQ ID NO: 15323 - RNA, 62 nt, Human; identical to SEQ ID NO: 9604

SEQ ID NO: 15324 - RNA, 62 nt, Human; identical to SEQ ID NO: 14918

SEQ ID NO: 15325 - RNA, 56 nt, Human
ggugagaaguaagcuaacagucuugcuuaguauucaagaaaauccaaacugugucu

SEQ ID NO: 15326 - RNA, 62 nt, Human
ggucugggcccuucagggagccgcggauuuuuauguucagaaagugauccugguuucuaggu

SEQ ID NO: 15327 - RNA, 57 nt, Human
augguuuguggaauccauuaugaagugcaauuagauagauguagguuccugccguuu

SEQ ID NO: 15328 - RNA, 62 nt, Human; identical to SEQ ID NO: 15326

SEQ ID NO: 15329 - RNA, 57 nt, Human; identical to SEQ ID NO: 15327

SEQ ID NO: 15330 - RNA, 62 nt, Human
uguguguauauggacuuugucccuuaaggucgauauaaagaauccucgcagaaucacagacc

SEQ ID NO: 15331 - RNA, 60 nt, Human
guauucauaguuaaagggaaucggguacuuugcuuguugaauaaugcacuuuaaaacaag

SEQ ID NO: 15332 - RNA, 62 nt, Human
aauaaauaaauaaauaaauaaaaggcagcuugaguuuccaaacgugugauucacuugugaac

SEQ ID NO: 15333 - RNA, 62 nt, Human
cuuccgucgugagggagcacuucccaggggccgcagggacgacacucuccagggaggcccca

SEQ ID NO: 15334 - RNA, 62 nt, Human
cuccaacacugcaacauggggacauuugccaacucgaacaaaggcugagaagcagccacacc

SEQ ID NO: 15335 - RNA, 57 nt, Human
aggggcaaaucacagcaauaugggugaaagacgaguaugccgaaucaaggcggaaca

SEQ ID NO: 15336 - RNA, 62 nt, Human
cacccucgcuuguccuggcgcccggcggcagcugcccagaaacuuccugggagaaagagccc

SEQ ID NO: 15337 - RNA, 62 nt, Human; identical to SEQ ID NO: 11624

SEQ ID NO: 15338 - RNA, 62 nt, Human; identical to SEQ ID NO: 11718

SEQ ID NO: 15339 - RNA, 62 nt, Human
gcuugcagcugcccugauggugcaggugcagggaggugaccauguaacucugaccaaucugg

SEQ ID NO: 15340 - RNA, 62 nt, Human; identical to SEQ ID NO: 13668

SEQ ID NO: 15341 - RNA, 62 nt, Human; identical to SEQ ID NO: 10854

SEQ ID NO: 15342 - RNA, 62 nt, Human
cuacagcaugauauuucagacuucccauuuggggaucugaaacaaucugggaguuaauaacu

SEQ ID NO: 15343 - RNA, 62 nt, Human
gucccuuuaaaaacuaacccacugaauauuccgugugaucuagaacaguguggcagcuuuca

SEQ ID NO: 15344 - RNA, 62 nt, Human
cugccucccuccugccccugcucccggggaggaaaggcuaaagcugcuggcccggggcccac

SEQ ID NO: 15345 - RNA, 60 nt, Human
acauccauuuuagaucacaagcaggaagucgauagucucaaaggcacuuuguuucuccca

SEQ ID NO: 15346 - RNA, 62 nt, Human
gucagggucggcuugugaaaaguuguuaaacaacaugcuaaaugugaaaugucaacccucac

SEQ ID NO: 15347 - RNA, 62 nt, Human; identical to SEQ ID NO: 10326

SEQ ID NO: 15348 - RNA, 62 nt, Human
aucuuuauuggguccguguguucucauuuccuucacuguuuauuuuuguuuguuuguuuguu

SEQ ID NO: 15349 - RNA, 62 nt, Human
aucugaaggggcgggguuagagccaagcugcacaauuuaauauauucaagaguggggggagg

SEQ ID NO: 15350 - RNA, 62 nt, Human
gccuccaccagcauccgagcaggaucaagggccggaaauaaaggcuguuguaaagagaaaug

SEQ ID NO: 15351 - RNA, 60 nt, Human
aaugagaccauggcucaaaaaaaaaaaaaaaaaaaagauaagcaguggaggccgaaucau

SEQ ID NO: 15352 - RNA, 62 nt, Human
ggauccucuucagcaccuggaaccuggaucacauaauagaaaagaaacgcaccaucauuccu

SEQ ID NO: 15353 - RNA, 60 nt, Human
acauagugcaaaacugugucacaguuucaggcuuuuaugaggaaagcguuucuguguaga

SEQ ID NO: 15354 - RNA, 62 nt, Human
aucacguugaaccacgugaaacugcuguuuucuaggccaaaaauggugagcgaucauuuauu

SEQ ID NO: 15355 - RNA, 60 nt, Human; identical to SEQ ID NO: 12344

SEQ ID NO: 15356 - RNA, 62 nt, Human; identical to SEQ ID NO: 9330

SEQ ID NO: 15357 - RNA, 62 nt, Human
gugcucaaaagagagagaucacucaaaugauuuuuauaaugaaaugacaagaauaacccuuu

SEQ ID NO: 15358 - RNA, 62 nt, Human
uaagcuauuuaaaaccaguaaggagacuugaaauucagaaaaucaacacauuuuuaaaugac

SEQ ID NO: 15359 - RNA, 59 nt, Human
ccucccaguacuaguuaauuuugaguaauuguauugucagaaaagugauuaguacuauu

SEQ ID NO: 15360 - RNA, 62 nt, Human
aguauguuucugugucaaucgcugugaaauaaagucugaaaacuuuaaaagcauugcuuuug

SEQ ID NO: 15361 - RNA, 60 nt, Human
aauuuugcacauggcggggucccgggaaggguggggagcaguuguccuuccugucgucgu

SEQ ID NO: 15362 - RNA, 62 nt, Human
gucaaagcaaggugccuuugguggcuuugugaagggugaaaaucagugaugggacauuuacu

SEQ ID NO: 15363 - RNA, 62 nt, Human
uuccccuccauaauuaagaugaaacauuccgguuuucucacaacacauuagcacauacuguc

SEQ ID NO: 15364 - RNA, 62 nt, Human
gacaggcaggagagauucuuccuaaagccucccccauaaaaagggagcuguggauccacuua

SEQ ID NO: 15365 - RNA, 62 nt, Human
ccuuuccauguaaguaccaacuuauauggaaacucacaaucauaauguaaagaagaaaugaa

SEQ ID NO: 15366 - RNA, 23 nt, Homo sapiens
aacauucaacgcugucggugagu

SEQ ID NO: 15367 - RNA, 21 nt, Homo sapiens
aacuggccuacaaagucccag

SEQ ID NO: 15368 - RNA, 23 nt, Homo sapiens
agcagcauuguacagggcuauca

SEQ ID NO: 15369 - RNA, 23 nt, Homo sapiens
agcagcauuguacagggcuauga

SEQ ID NO: 15370 - RNA, 21 nt, Homo sapiens
agggcccccccucaauccugu

SEQ ID NO: 15371 - RNA, 21 nt, Homo sapiens
cacgcucaugcacacacccac

SEQ ID NO: 15372 - RNA, 22 nt, Homo sapiens
cugugcgugugacagcggcuga

SEQ ID NO: 15373 - RNA, 22 nt, Homo sapiens
uagcuuaucagacugauguuga

SEQ ID NO: 15374 - RNA, 22 nt, Homo sapiens
aguguggggggcccaaggcugc

SEQ ID NO: 15375 - RNA, 21 nt, Human herpesvirus 1
uggaaggacgggaaguggaag

SEQ ID NO: 15376 - RNA, 22 nt, Human herpesvirus 2
agaguucacucggcacgcaugc

SEQ ID NO: 15377 - RNA, 22 nt, Human herpesvirus 2
gugcuugccuagcgaacucacc

SEQ ID NO: 15378 - RNA, 22 nt, Influenza A virus
cugccaaaaaggcaacauuagg

SEQ ID NO: 15379 - RNA, 84 nt, Homo sapiens
gaggacuccaaggaacauucaacgcugucggugaguuugggauuugaaaaaaccacugaccguugacuguaccuugggguccuu

SEQ ID NO: 15380 - RNA, 79 nt, Homo sapiens
gggagcugagggcugggucuuugcgggcgagaugagggugucggaucaacuggccuacaaagucccaguucucggcccc

SEQ ID NO: 15381 - RNA, 86 nt, Homo sapiens
uucucucugcuuucagcuucuuuacaguguugccuuguggcauggaguucaagcagcauuguacagggcuaucaaagcacagagag

SEQ ID NO: 15382 - RNA, 84 nt, Homo sapiens
ucuuacugcccucggcuucuuuacagugcugccuuguugcauauggaucaagcagcauuguacagggcuaugaaggcauugaga

SEQ ID NO: 15383 - RNA, 80 nt, Homo sapiens
aggacccuuccagagggcccccccucaauccuguugugccuaauucagaggguuggguggaggcucuccugaagggcucu

SEQ ID NO: 15384 - RNA, 127 nt, Homo sapiens
gcgcggccgagggaccugcgugggugcgggcgugugagugugugugugugagugugugucgcuccggguccacgcucaugcacacacccacacgcccacacucagggucugcccccucggccugcgu

SEQ ID NO: 15385 - RNA, 84 nt, Homo sapiens
ccaggcgcagggcagccccugcccaccgcacacugcgcugccccagacccacugugcgugugacagcggcugaucugugccugg

SEQ ID NO: 15386 - RNA, 90 nt, Homo sapiens
guaccaccuugucggguagcuuaucagacugauguugacuguugaaucucauggcaacaccagucgaugggcugucugacauuuugguau

SEQ ID NO: 15387 - RNA, 82 nt, Homo sapiens
ggcugagucaguguggggggcccaaggcugcgucagugaggggagagcugacguagccccccccagaccggcgggaccagcc

SEQ ID NO: 15388 - RNA, 86 nt, Human herpesvirus 1; identical to SEQ ID NO: 2858

SEQ ID NO: 15389 - RNA, 92 nt, Human herpesvirus 2
gcgcgucggggcgggagaguucacucggcacgcaugcacguguaaccgccaguccgugcuugccuagcgaacucacccgucccggcuggcgu

SEQ ID NO: 15390 - RNA, 103 nt, Influenza A virus; identical to SEQ ID NO: 1403

SEQ ID NO: 15391 - RNA, 59 nt, Influenza A virus; identical to SEQ ID NO: 1489

SEQ ID NO: 15392 - RNA, 82 nt, Human herpesvirus 2
gucggggcgggagaguucacucggcacgcaugcacguguaaccgccaguccgugcuugccuagcgaacucacccgucccggc

SEQ ID NO: 15393 - RNA, 63 nt, Homo sapiens
aaaaauguagaaauucuucaugaacauaacucugcugaauguaaaagaaaauuuuuuuucaaa

SEQ ID NO: 15394 - RNA, 62 nt, Homo sapiens
aaaauuugacuccucuucaagcuugaaaacccucugaacucagucuucuuuaccucauuauc

SEQ ID NO: 15395 - RNA, 63 nt, Homo sapiens
aaacaagaaguuaguucuauuuagcagguuaaaaaaugcugcauuagaauuaaagcaaguuau

SEQ ID NO: 15396 - RNA, 61 nt, Homo sapiens
aaacaguguugugacugucucaugggaagagcuggggcccagagggaccuugagucagaaa

SEQ ID NO: 15397 - RNA, 61 nt, Homo sapiens
aaagcccagaaaaggacagaaacgaaguagaaaggggcccaguccuggccuggcuucuccu

SEQ ID NO: 15398 - RNA, 62 nt, Homo sapiens
aaauaaugcagauaucugcccucugaacaaaaauuuuggcaaaguaaauuuguagcaacaga

SEQ ID NO: 15399 - RNA, 63 nt, Homo sapiens
aaauuaaugacaacucaugcuuuaauuuuguauuuugaauguacacgcaugcugaagcuaagu

SEQ ID NO: 15400 - RNA, 63 nt, Homo sapiens
aagcacauggccuugggugacaaauuccucuuugaugaauguacccuguggggauguuucaua

SEQ ID NO: 15401 - RNA, 62 nt, Homo sapiens
aagggauggaaaaggaagacuagaggcuugcauaauaagcuaaagaggcugaaagaggccaa

SEQ ID NO: 15402 - RNA, 63 nt, Homo sapiens
aauagucuagucaccaaaggaccauucucuugccaaugcugcauuccuuuugcacuuuuggau

SEQ ID NO: 15403 - RNA, 62 nt, Homo sapiens
aaucucuccuuggucuuaaggaaaauacuaacauugaacucacugacaugaucuuagcuucu

SEQ ID NO: 15404 - RNA, 62 nt, Homo sapiens
acagcaccucuuguccaggugcaucucauacaccugaacucauuugcaucauuuuaaccauc

SEQ ID NO: 15405 - RNA, 61 nt, Homo sapiens
acagguugacuguguacccccaaccaaggagcuggggcccaaggccaguccugccccagag

SEQ ID NO: 15406 - RNA, 62 nt, Homo sapiens
acccuauaaguguuacugucaggauaacaugagaacgcacaacaguaaguggucacuaagug

SEQ ID NO: 15407 - RNA, 62 nt, Homo sapiens
acccugggccccugucgucaggaccuccugaggcuuuggcaaauaaaccuccuaaaaugauu

SEQ ID NO: 15408 - RNA, 62 nt, Homo sapiens
acuccucaccccagcucaagccauggcaggcguggcaagcaaaguggggaggagacaguccc

SEQ ID NO: 15409 - RNA, 61 nt, Homo sapiens
agaaaaaacaaaaaaaaagggccagaaagucauuccuuccaucuuccuugcagaaaccacg

SEQ ID NO: 15410 - RNA, 62 nt, Homo sapiens
agcagauaccucacccugcuacacauacaggauuugaacucagaucugucugauaggaaugu

SEQ ID NO: 15411 - RNA, 62 nt, Homo sapiens
agcccuugagcagcccgugugggggcccgagggacccacacagugggggccagccucgcugg

SEQ ID NO: 15412 - RNA, 61 nt, Homo sapiens
aggaccaggggcuacucuggccugcagcgucuguccuuccagguuccuggcagugagaggc

SEQ ID NO: 15413 - RNA, 62 nt, Homo sapiens
aggcagccaggccacaagacccuuguggucccaccccacacacgccagauucuuuccugagg

SEQ ID NO: 15414 - RNA, 62 nt, Homo sapiens
aggcagggaagcaauguaguguggugggcagagccccacacagaaucagaagggaugaaugg

SEQ ID NO: 15415 - RNA, 61 nt, Homo sapiens
aggcauguggugcuggggauuggcagccauccuggggcccacacaggugugucuugcucca

SEQ ID NO: 15416 - RNA, 63 nt, Homo sapiens
aggccagccggccucucgagagccagagcagcaguugaauguaaugcuggggacaggcaugcu

SEQ ID NO: 15417 - RNA, 62 nt, Homo sapiens
aggguggggaacuggaggguggggggauugaaaugcaagcaauuaguggaucacuguuaggg

SEQ ID NO: 15418 - RNA, 62 nt, Homo sapiens
agguacaagcuuugugcuaagaaguugacauacuauaagcuacaaaaguucuguaaaguaga

SEQ ID NO: 15419 - RNA, 63 nt, Homo sapiens
aguucauuucacugggauuuugaagcauuucugucugaauguaaagccuguucuaguccuggu

SEQ ID NO: 15420 - RNA, 61 nt, Homo sapiens
auacaagguauaauaaaauuaucgcaaccccucuccuuccaguauaaccagcugaaguugc

SEQ ID NO: 15421 - RNA, 63 nt, Homo sapiens
auagucaaauuauguauugguggggcuggguaccaaugcugcaggucaacagcuaugcuggua

SEQ ID NO: 15422 - RNA, 61 nt, Homo sapiens
aucuauucaucuggaucaugggacccucucuaauccuuccaccaaucaaauaagcuauugc

SEQ ID NO: 15423 - RNA, 61 nt, Homo sapiens
aucugcaaugaaucuagaugcaauuaauuuuauuccuuccaacuaaaauuacaauauuuuu

SEQ ID NO: 15424 - RNA, 63 nt, Homo sapiens
aucuggagaccagggagccuuugguucuggccagaaugcugcaggacuugagaagaccucacc

SEQ ID NO: 15425 - RNA, 63 nt, Homo sapiens
auugagauuccuaucugcccuuguauuuuuauaacugaauguaaauaggaauugcuuaaauac

SEQ ID NO: 15426 - RNA, 63 nt, Homo sapiens
auugcuauaacguguguacugaccuuauguggaaaaugcugcaacccuguuuacugccuaugu

SEQ ID NO: 15427 - RNA, 62 nt, Homo sapiens
auuggaaaugaaacugcugugaauguggauucuucccacacagaauauacauuguccucuuu

SEQ ID NO: 15428 - RNA, 63 nt, Homo sapiens
auuuauuauuuauuuauuauuuauuuauuuacagaugaauguauuuauuugggagaccggggu

SEQ ID NO: 15429 - RNA, 62 nt, Homo sapiens
auuugggggggaauaagauuauauggacuuucuugcaagcaacaagcuauuuuuuaaaaaaa

SEQ ID NO: 15430 - RNA, 62 nt, Homo sapiens
auuuuaacaauguuaauucuugcagaccaugaacauaagcuaccuucccauuuauaugcguc

SEQ ID NO: 15431 - RNA, 62 nt, Homo sapiens
caccugcaaucaaguccuacaagcuaaaauuagaugaacucaacuuugacaaccaugagacc

SEQ ID NO: 15432 - RNA, 62 nt, Homo sapiens
caccuuugcaucuuuugugucuuucuuaucaugauuuggcaaaaugcaucaccuuugaaaau

SEQ ID NO: 15433 - RNA, 63 nt, Homo sapiens
cagagaaaauaacaucacuuauuuauuguuguuggaugcugcaaaguguuaguagguaugagg

SEQ ID NO: 15434 - RNA, 62 nt, Homo sapiens
cagcaucaaagagauggugcuaaaccauucaugaugaacucacccccaugauccaaucaccu

SEQ ID NO: 15435 - RNA, 62 nt, Homo sapiens
cauguggugcuggggauuggcagccauccuggggcccacacaggugugucuugcuccauuug

SEQ ID NO: 15436 - RNA, 63 nt, Homo sapiens
cauuuuccuuauuguuaaaaacauguuagaagcaaugaauguauauaaaagccucaacuaguc

SEQ ID NO: 15437 - RNA, 62 nt, Homo sapiens
ccagccuucugggggugcuaugaggugauccguccccacacaugggaugggggaggcagaga

SEQ ID NO: 15438 - RNA, 62 nt, Homo sapiens
ccauggaucaucaaggugaaacacuuugguauucuuuggcaaucagugcuccuguaagucaa

SEQ ID NO: 15439 - RNA, 61 nt, Homo sapiens
cccacgccuuagcugcaggcccuuuugggcaaaggggcccauccuagaccagaggagccca

SEQ ID NO: 15440 - RNA, 61 nt, Homo sapiens
cccagcccagccccaccacagaucccagagauaggggcccagucuccaugggggcaaggag

SEQ ID NO: 15441 - RNA, 61 nt, Homo sapiens
ccccucccucccucacuuccucccucucccccauccuuccauucuuccccucccucccuuc

SEQ ID NO: 15442 - RNA, 62 nt, Homo sapiens
cccuugguccugccccuagauacagcaguuuauacccacacaccugucuacagugucauuca

SEQ ID NO: 15443 - RNA, 62 nt, Homo sapiens
ccgggcccugucucucaggaccacggcggccugccccacacacaguucugcuucucccuauc

SEQ ID NO: 15444 - RNA, 63 nt, Homo sapiens
ccucuucaugagaggccuccuuuucuucaccuuuuaugcugcacuccuccccuaguuuacaca

SEQ ID NO: 15445 - RNA, 62 nt, Homo sapiens
ccuucuagggagcacccucccaccccccaccccccccacacacaccaucuuuccaucccagg

SEQ ID NO: 15446 - RNA, 63 nt, Homo sapiens
cggucugcauaaaugcuguauacauaccagauuugaugcugcauauaggguauggaauugcac

SEQ ID NO: 15447 - RNA, 63 nt, Homo sapiens
cucaguucagaaucacuucugagaacucaucccuaaugcugcagauuugggcuggaacagauu

SEQ ID NO: 15448 - RNA, 61 nt, Homo sapiens
cucuguggggcugagcaacauuuuuacauuuauuccuuccaagaagaccaugaucucaaua

SEQ ID NO: 15449 - RNA, 63 nt, Homo sapiens
cugaaagaugcuaaucuauuugccaaacuuggucuugaauguacugggggcuucaagguaugg

SEQ ID NO: 15450 - RNA, 62 nt, Homo sapiens
cugagcagucagaagaccuggucgucgucuugacuuuggcaaaugagccggagccccuuggg

SEQ ID NO: 15451 - RNA, 62 nt, Homo sapiens
cugucaccccaaaugcagcaauggccuggugauucccacacauccuuccugcaucccccgac

SEQ ID NO: 15452 - RNA, 63 nt, Homo sapiens
cuguuucucccuugggacugugucucauguuugugugaauguagaccaggaaagggggcugca

SEQ ID NO: 15453 - RNA, 61 nt, Homo sapiens
cuuuccucucuuagcccuuagaagucaccuacuuccuuccagugccaugaucccaccugcg

SEQ ID NO: 15454 - RNA, 63 nt, Homo sapiens
cuuucuaauuaggcauuuuauguuagucacagucuugaauguauaaacagcacuaagacucuc

SEQ ID NO: 15455 - RNA, 63 nt, Homo sapiens
cuuuguuaaggaacucuuuuggaauaaagagcaggaugcugcaaaguuuggauuguauuuugg

SEQ ID NO: 15456 - RNA, 62 nt, Homo sapiens
gaacagggguguauuucauuccaggcccucagucuuuggcaauggccacccugguguuggca

SEQ ID NO: 15457 - RNA, 61 nt, Homo sapiens
gaagucucccuggucugacccaccaggaucccaggggcccaaggcggccccucccgccccu

SEQ ID NO: 15458 - RNA, 62 nt, Homo sapiens
gacuccuccuuggcaacugcccuuuccugccaggcccacacauacccucuucuggcuguuag

SEQ ID NO: 15459 - RNA, 63 nt, Homo sapiens
gagagcaugccugugggagucauggacaugaagggaugcugcaauguaggaaggagagcucuu

SEQ ID NO: 15460 - RNA, 62 nt, Homo sapiens
gagcagcagaggcggucuucaacauccugccagccccacacagcuacagcuuucuugcuccc

SEQ ID NO: 15461 - RNA, 63 nt, Homo sapiens
gagccauggggugucgggggcuccugugcaggcucaugcugcaggcggccgagggcacagggg

SEQ ID NO: 15462 - RNA, 62 nt, Homo sapiens
gauuuggcauuuuauauauguugauucaaucaaguuuggcaagcaggguguucgauacugcu

SEQ ID NO: 15463 - RNA, 61 nt, Homo sapiens
gcaagagacagagcccccaagccucugccccaaggggcccacaaaggggagaagggccagc

SEQ ID NO: 15464 - RNA, 61 nt, Homo sapiens
gcaugggccacguaggaggcuccugacuugccaggggcccagccucagcauacccaccgag

SEQ ID NO: 15465 - RNA, 61 nt, Homo sapiens
gcggaauugcucucccagcccuugcauugcagaggggcccaugaaagaggacaggcuaccc

SEQ ID NO: 15466 - RNA, 62 nt, Homo sapiens
gcugguggauggugacuuuugaagaacaaaaggcuuuggcaacagaaaacaauuguucuggg

SEQ ID NO: 15467 - RNA, 61 nt, Homo sapiens
ggcugcaaugcagcauguugcccuggcaccuguggccaguacucgggacagacuaagggcg

SEQ ID NO: 15468 - RNA, 61 nt, Homo sapiens
gggcauuguccagaaacuccccugagaccuuacuccuuccagccccaaaucauuuacuuuu

SEQ ID NO: 15469 - RNA, 61 nt, Homo sapiens
gguccagaugugggggccuguccaaggguggcuggggcccagggcaucgcuaaacccaaau

SEQ ID NO: 15470 - RNA, 63 nt, Homo sapiens
ggugucugccccgcguuuccugccugcggaccagaugaauguagcagauccccagccucuggc

SEQ ID NO: 15471 - RNA, 62 nt, Homo sapiens
gugaggaagaguguuuacuaaauaaaugacuggggcaagcaaaauugaggaggaaauuagaa

SEQ ID NO: 15472 - RNA, 61 nt, Homo sapiens
gugcccaguuagccucugcaggauguggaaaccuccuuccaggggagguucagugaauugu

SEQ ID NO: 15473 - RNA, 62 nt, Homo sapiens
guggcuuccuccgucugcaaugucccuugcacagcccacacaugaaccauccuucccaugau

SEQ ID NO: 15474 - RNA, 61 nt, Homo sapiens
gugugggucgaggauucugugccuccaggaccaggggcccacccucugcccagggaguccu

SEQ ID NO: 15475 - RNA, 62 nt, Homo sapiens
guucuuauguugcccaguguguuucugaucugaugcaagcaagaaacacugggcuucuagaa

SEQ ID NO: 15476 - RNA, 63 nt, Homo sapiens
guugauguuuuaacucuaucugucauacauccuagugaauguaaaaugcaaaauccuggugau

SEQ ID NO: 15477 - RNA, 62 nt, Homo sapiens
uacaguugggcaugauuuguaccauccacccauacccacacagucacagucacacacacaua

SEQ ID NO: 15478 - RNA, 62 nt, Homo sapiens
uacauguaguuugaaauaagguauccugaguuacuuuggcaacaaguucuuuuacccuuacc

SEQ ID NO: 15479 - RNA, 62 nt, Homo sapiens
uacauuguugagcuauugcuguucucuugggaacugaacucacuuuccuccugaggcuuugg

SEQ ID NO: 15480 - RNA, 62 nt, Homo sapiens
uacguagucaucaacaauuugaccagggccuuuauuuggcaaauaacugagccaaccagaau

SEQ ID NO: 15481 - RNA, 62 nt, Homo sapiens
uauacucuccuuuugaaaagauaccauaaagcacauaagcuagaucacuacaaggagcuguu

SEQ ID NO: 15482 - RNA, 63 nt, Homo sapiens
uauuuauuuaaauauuuaaauuuuauauuuauuguugaauguaugguuugcuaccuauuguaa

SEQ ID NO: 15483 - RNA, 62 nt, Homo sapiens
ucaugggacccucucuaauccuuccaccaaucaaauaagcuauugcuauugguuuggaguug

SEQ ID NO: 15484 - RNA, 62 nt, Homo sapiens
ucccaauucacaucuaaccucaucuucuucaccauuuggcaaugccaucaucuccugccuuc

SEQ ID NO: 15485 - RNA, 61 nt, Homo sapiens
uccucaguuaaccuacacccaccugaauauagaugagcguagcugaguuuucacccguagg

SEQ ID NO: 15486 - RNA, 63 nt, Homo sapiens
uccuggacuaaauuccccuuggggaagacgaagggaugcugcaguuccaaaagagaaggacuc

SEQ ID NO: 15487 - RNA, 63 nt, Homo sapiens
uccuggccuaaauuccccuuggggaggacagggagaugcugcaguuccaaaagagaagguuuc

SEQ ID NO: 15488 - RNA, 63 nt, Homo sapiens
ucuauuauuauuggcuccuucugggaagaaccaagugaauguagggguugaaggaacacauac

SEQ ID NO: 15489 - RNA, 61 nt, Homo sapiens
ucuuaaguugauuuuuguaugcagaguaagcugggggcccaguuucaaucuucugcauaug

SEQ ID NO: 15490 - RNA, 62 nt, Homo sapiens
ucuuucuuuucucuuuuccuuuuuuuuuucuuuuuuuggcaaccuggcucuggcccaggcua

SEQ ID NO: 15491 - RNA, 62 nt, Homo sapiens
ugaaaauuccuaugaccuucuccccgauuaucccuuuggcaauauagagucaaauaauaaca

SEQ ID NO: 15492 - RNA, 62 nt, Homo sapiens
ugaaguuuccuuggcuggugcaccuagaauuggcugaacucaugagaaguugauauagaaca

SEQ ID NO: 15493 - RNA, 63 nt, Homo sapiens
ugaccauagcuccuucucucuuacauugaauguagagaauguagccauuguagcagcuugugu

SEQ ID NO: 15494 - RNA, 61 nt, Homo sapiens
ugagaaaccuggcagccugcuguuaacaacacaggccaguauuggguuuuauugaauuugg

SEQ ID NO: 15495 - RNA, 63 nt, Homo sapiens
ugagucaaggaguguaaccuucuccuuuacuauguugaauguauuuuuuucuggacaagcuua

SEQ ID NO: 15496 - RNA, 63 nt, Homo sapiens
ugcauggagugaccauagcuccuucucucuuacauugaauguagagaauguagccauuguagc

SEQ ID NO: 15497 - RNA, 61 nt, Homo sapiens
uguacccaccgggccacuccuuccugccccaacuccuuccagcuagugacccacaugccau

SEQ ID NO: 15498 - RNA, 63 nt, Homo sapiens
uuaauguugagcuaagaagcauuaagucuuugaacugaauguauuuugcaucccugguuuugg

SEQ ID NO: 15499 - RNA, 62 nt, Homo sapiens
uuacuguuauuuuaccugauaaguuauugaacccuuuggcaauugaccauauugugagcaaa

SEQ ID NO: 15500 - RNA, 61 nt, Homo sapiens
uuacuucauggacuuccacugccauccucccaaggggcccaaauucuuucaguggcuaccu

SEQ ID NO: 15501 - RNA, 63 nt, Homo sapiens
uuaugcucuggcaucuaacauaugauucuguaguaugaauguaaucaguguauguuaguacaa

SEQ ID NO: 15502 - RNA, 62 nt, Homo sapiens
uuauuccaggugaagggaaggaaguguauauacuuuuggcaagucauacagcucaaauguga

SEQ ID NO: 15503 - RNA, 61 nt, Homo sapiens
uuccacagggacaacgguuuagcuaugaaauuuggggcccaaaauuucacacuucaugugc

SEQ ID NO: 15504 - RNA, 61 nt, Homo sapiens
uucucuuaauaagcccacauauaaauguacuuuuccuuccagaaaaauuucccuugaggaa

SEQ ID NO: 15505 - RNA, 63 nt, Homo sapiens
uuggaaaccaucacuauugagagaugggaaaaaccugaauguauaaagcauuuauuugucaau

SEQ ID NO: 15506 - RNA, 62 nt, Homo sapiens
uuuaaauggaaaaagcaaaggagaaaucaguaggugaacucagccauuagaggaagaacugg

SEQ ID NO: 15507 - RNA, 62 nt, Homo sapiens
uuucugacucaugaaaagagcacagaaaaggauguuuggcaauuugucuuuuaagucuuaac

SEQ ID NO: 15508 - RNA, 62 nt, Homo sapiens
uuugaaccugugaaaugcuuuaccuuguuuacaguuuggcaaaguugcaguuuguucuuguu

SEQ ID NO: 15509 - RNA, 62 nt, Homo sapiens
uuugcuguuauuuuaucugcuaugcuauugaaguuuuggcaauugacuauagugugagccag

SEQ ID NO: 15510 - RNA, 63 nt, Homo sapiens
uuuuauguaauaucauguguaccuuuacauuguggugaauguaacaauauauguucuucauau

SEQ ID NO: 15511 - RNA, 62 nt, Homo sapiens
uuuucuguguuuagcuauuuaauacuaauuuuccauaagcuauuuugguuuagugcaaagua

SEQ ID NO: 15512 - RNA, 62 nt, Homo sapiens
uuuugcuaggucacagaggaucugcuuggucuugauaagcuauguuguugcacuuuaaacau

SEQ ID NO: 15513 - RNA, 62 nt, Homo sapiens
uuuuguuaugacuuagcugacuuguggcagcggggcaagcaaaaacaauaacacugcuuaua

SEQ ID NO: 15514 - RNA, 62 nt, Homo sapiens
uuuuucauucacuuuaauagaagggcaaauauuuauaagcuauuucuguaccaaaguguuug

SEQ ID NO: 15515 - RNA, 63 nt, Homo sapiens
uuuuuuuguacuuagugaauuuguaugcaacagagaugcugcagcugaugccuuuaaaaggua

SEQ ID NO: 15516 - RNA, 31 nt, Epstein-Barr virus
guggaaccuaguguuaguguugugcuguaaa

SEQ ID NO: 15517 - RNA, 31 nt, Artificial sequence
  Synthetic
uuuacagcacaacacuaacacuagguuccac

SEQ ID NO: 15518 - RNA, 22 nt, Epstein-Barr virus
aaauucuguugcagcagauagc

SEQ ID NO: 15519 - RNA, 31 nt, Artificial sequence
  Synthetic
aucagcuaucugcugcaacagaauuuaaaag

SEQ ID NO: 15520 - RNA, 31 nt, Epstein-Barr virus
gggucuuaguggaagugacgugcugugauaa

SEQ ID NO: 15521 - RNA, 31 nt, Artificial sequence
  Synthetic
uauucacagcacgucacuuccacuaagaccc

SEQ ID NO: 15522 - RNA, 31 nt, Epstein-Barr virus
agacuauuuucugcauucgcccuugcguguc

SEQ ID NO: 15523 - RNA, 31 nt, Artificial sequence
  Synthetic
gacacgcaagggcgaaugcagaaaauagucu

SEQ ID NO: 15524 - RNA, 22 nt, Epstein-Barr virus
cgcaccacuagucaccaggugu

SEQ ID NO: 15525 - RNA, 31 nt, Artificial sequence
  Synthetic
ggugacaccuggugacuaguggugcgcugga

SEQ ID NO: 15526 - RNA, 22 nt, Epstein-Barr virus
gaccugaugcugcuggugugcu

SEQ ID NO: 15527 - RNA, 31 nt, Artificial sequence
  Synthetic
auuuacagcacaccagcagcaucagguccca

The invention claimed is:

1. A method of reducing the amount of virus replication in a target cell, the method comprising introducing into a target cell infected with the virus an effective amount of a composition comprising an isolated nucleic acid, wherein the nucleic acid consists of:

(a) SEQ ID NO: 15,372;

(b) a DNA encoding (a), wherein the DNA is identical in length to (a);

(c) a sequence at least 80% identical to (a) or (b), wherein the sequence is 13-33 nucleotides in length; and (d) the complement of any one of (a)-(c), wherein the complement is identical in length to (a).

2. The method of claim 1, wherein the target cell is in vitro.

3. The method of claim 1, wherein the target cell is in vivo.

4. The method of claim 1, wherein a subject comprises the target cell.

5. The method of claim 1, wherein the virus is hepatitis B virus.

6. A method of reducing the amount of virus replication in a target cell, the method comprising introducing into a target cell infected with the virus an effective amount of a composition comprising an isolated nucleic acid, wherein the nucleic acid consists of:
- (a) SEQ ID NO: 15,385;
- (b) a DNA encoding (a), wherein the DNA is identical in length to (a);
- (c) a sequence at least 80% identical to (a) or (b), wherein the sequence is 45-200 nucleotides in length; and
- (d) the complement of any one of (a)-(c), wherein the complement is identical in length to (a).

7. The method of claim 6, wherein the target cell is in vitro.

8. The method of claim 6, wherein the target cell is in vivo.

9. The method of claim 6, wherein a subject comprises the target cell.

10. The method of claim 6, wherein the virus is hepatitis B virus.

* * * * *